United States Patent 11,913,074 (METHODS FOR ASSESSING RISK OF DEVELOPING A VIRAL DISEASE USING A GENETIC TEST) - sequence listing, part 7

SEQ ID NO: 221 - DNA, 441169 bp, Homo sapiens
  source 1..441169: mol_type = genomic DNA
ttgaccacattcatttatttttataatgtcaatgtattattgatagcattaaaaatgttacagaaggcaatggacacattgtactgatgtgatattaagaaacattgctagctatggcaccaaaatttatgtgacataaggaaattataatacctaacacatattagttttctcttccctggttctaactagcaagtgccaggaggcaggctgggttagacagcgtgaccaagagtaaactttggatggtccaggataaaattataacataggtggtttgtcgttgcttgtgtttatttaatgttctctcgctttccttgtctagccaagatcccatgctatgttgacttgtcatctccagaaatgtcttcacacttggaagttcccttaaaaagcccttaaaatttacctcctctaggacttactagttccaattttttcaatattaatacacatatgaatcatctggggatcttgcccaaaagcggacttctgtaggtacagggtaaggccaaggactctgcacttcttgtaattatacttctgggtgatactgacgctgcagttccatgcaccacactttccacagtgaggcacgcaagaacatttagaactgcacattttaaacagaattgtaatatgttaggttggtaatagatgttagaagagttaggcaaacaagatttaattttgaatgcttggaaactaagaccttgaacaaatatgagaaagaaatgagaatacatttggaaaactctttttgaatctttcaaatttctttgggttatgttctttcttccttcaaaagtaaatctttcctttctcaggagttttcctcacaaatttaacaggaaataaaaacctttcaagaaagtctctttgcctctacacatctgaatattctctgtagaaaacgatgcaacctgtttttttgcaaaattccgttatttaaaaaaaaaagtctgaataactctacgttacctgaattcaattatataatctattggaaacataaagtggtcctcttttgaagaattattatatttactaatttattcagatttcttcaattgaatgaatcaatagtattctctgctcatatggtattactgaaacaactacatagaaaaaaatagcagggccgggtgcggtggctcaggcctgtaatcctagcacttctggagggtgaggcgggcggatcacttgaggttaggggttcgagaccggcctggccaacatggtaaaaccctgtctctactaaaaattacaaaaatttagctagccatggtggcgggcacctgtaatcccagctactctggaggctgatgcaggagaattgcttaaacctgggaggctgatgttgcagtgggccaagatcctgccattgcactcccacctgggtgacagagccagactccatcttaaaaaaaaaaaaaaaaaaagatgtttccctttgggagtaaatggccattgatgttacattagaaatataatagctccaaagaatgttcacctttgccactctttggagcgtgtgtgatatctccaatagaaattaaagaactggcttcacttttttgtttgtttgggtttttcttgagaaagggttttgctctgtcccccaagctggagtgcagtggaacgaacagggctcactgcagccttgacctcctaagttcaagcgatcctcctgccttaactttctgagtaactaggactacaggaatacaccacctatagtcgggttttctaaacactgcaggtatgtaagtatatactggtcaattaaaaaaattttttttccttgtagagaccaggtcttgacatgctgccctggttggtctccaattcctggcctcaagcattcctcccactttggcctcccaaagtgctaggattacaggcatgagccaccacgcctggcctgagaacttgctttattttagccaaaattattttatcacttctttcccttctcacaggttctagctcttatcttcttgtaccccttccctgccgcaatatattatcttacgcaaagcaagtaaactttcagtttcctattcccattactctatttagcaaacctaggaccttccttaggacccagcatcctcacaaggcagggtggggttgtaaatagcccccagtttttgctgtgtcataaattattttattccttgttacattagcaaaacagacatttcaatgtgaatcctccccgttgataagcttaaattaagaatataaagtacaacactgtaaaacctttgccctgatgttaaaagcctttcagaaggtttttgaaatccctatttcccacttgatctgggttcctcttcaccctgtgagacactccagctgcattgaactgccagtgttcccaatcagctgtgctctgttaaacatccacattttagaaaagcatgcttaatttttcactaaatgataattatttccccagcatttaatgtattactcattctctccacatcaaggaccttgtaaacaaattcagagcattatctgtaggttcttttaagatcatctttaaataattttcaaggtgggatgcggggagtgtcagcaaggcttctctcattaaaaaaccttaaaatctccatttgtccctgtcaaagcctgaattggaagcagggtcagcattagggtgagacaagagatgcagggttgtgcaagtgcagggttgttaaaaaggaaaaaaattgaaattgcttaagaaagtcattgcttttgaggggtaatagcaggtgtacttccctaagtacaatagcaaatctttcaaagaaaatttctatcctatttttccttgaaaataaccatattgaatacagttatagaactgtattttatttatttgtatgtgctacaatttggtgcatgcagcaaccacagttccttaaatttttggccattgttttcaggactcaaaatagctcagcattccattctataaggcccatgtttctttcccatggtacagtatgagtactttttaaagtaggtgaacataaaataaaagtttgctagttgtagtgcatatgaacaaaataaccacatgggttttatggcacatgttctaaaaagataaagatataatggagagatatctcattcaaacaggttaacattataaacagtgcaagtgagggccatagaagcaaagtaacatagtaaaattaacaaatataaaaacctaagctgaaagaggaggtatggagattttttaaatagtcctgaaagataatagagattgctcataatttgaagtagacataattcaggatttgaaataaatcatctaaaattttaaacatgtcatattgtttaaatcattctctgtcctataggaatgacggtaataacttgactatgtactttgtagtgtcctgaaaatagtatgctcagttaagtttataaattgcaaaataaccatctctttaaagtggaacagcattcatcagggaattgttcacttatgaagaggtcatccagacctggagacaagctacttttttggtgaatagaatatattgccattgctactatttatcctccttgttttcaggaatgcttcactacttattctcattatgataaactctatctcaggcttttaggtatcatttaaaacccacttgtgtggggaggttctatcactctccaaataactttgcagggcccaaggctataaatatgaatatatttatacaaacctattttgttataatagggccttgggcctactatacaaacctattttgtttaaggctataaatatgaatgtatttatataaacctgttttgttataatagagcccaaggccctattataacaaaataggtatgttataaaactattataacaaaataggtatgtcatagaactattataacaaaataggtttgtataaatatattacaggacaattatttaccattattacaggaaaattatttctcatctgtatatccaataattacacaaaatggttgtgttttgaagttggagaacaaccacattctaaaaaggcacagagcaaaaaagaaaataagctcatattttactatacgaaaaaggtaaacaaagaagtggttgaaaaatccatgttctatttaaagtcctctcattccagaattatagaatataattgattttatgtgattatcaagtataagctcttggaaattttatgatgtaaaaatagaggcaaagctgtactcattaataaaataaaacatttgattagcatatattgataaaataaaatattcatgattgtagtttattttttgttgaatttattaataatctttatatatatttatatatgtatggctttgagcaaagacaaaagaaatactctaactcatccctgatcatacagttgttgtaagaatcagctattctattatctttccagcagcagaaagaccaatgaataatacatttctttctgtacagattaaaactccatacatacgggcttcactatgtacagagaaaagaggtcacttttcaactagcaatggacctttatattacaggaatgtgagtcatttttttttcttaatctaagtatatatacattcatacatatatgtatataatttaccctgtacctttttattagtttaatatataaaccttagtttttttgtccattctattacaaagtgaataaaaattgtatggttgcactgaaagaccatgcatttcaattttgcttatgtttcccaatagtgctcaaaataaaaaaccaaaaatttatatatataaaaatatttcactaccaaatccattaatcctatcaaatgtaaacctttaataatttaaaggaccaatacgtaatcttaataaattgaagttaattctcatattttaataaaataaaggagttttgtactgatatgtaaatggtcttgcagctttcccataggttctaggtagactgaacaatccctttcttacaacagtattcctgacatgccatcatatgtcaccagcatattgatgattacattacatcgactagcagttaattacttccacaccagttgggatttgtttgaaattaaacataacaactcattttggtattataggtattatatccacaaaaggcataacaggcagcaaggatccactttagagtttctgcttttgtttttgttttctgtcctcaagtctatctgcaggccctgtcccacataatgtgtgatctctgtatgttcttaaatgtattgccagtgccagagatactgaagacctccactttaagtcatgctcttaacttgggttatttaccgcagccagttgttaggaatctttcaattgtgttccagtcatactccacatgtgtgggatgcattaggcacaaatgattactaagggagttctttgagaagaagcaggtgctcacagatcatgtaaagagttaagaaaacagacagacaatgctcatagacgttcaactttacccctgctttctgtcaccatgtctgtactattttcaacacattaaaaatgacaaacctcctatctaagggctacgttagtcaccacatgccttaaagtttactaaccatttagttacaatatacatagagcaaaatgtgtgttcccaaacagacgtgatgctgtattgaatttatttctttaaattaataccatagtaaattaccagctacagtgaagacacagacaacacttaactccaaatcaagctgtggtttacaaataattatttaaataataatagcaataatattaaataaaagtgaaaacctcacttctagacttaagtcagagatccaagtcagccttataggaattataagataggcaattaatgaattgttatgcttttctagaaacgagaaatactgtaagcctttctctacaatgactgatttgaacctatttttttttccccagaagcatgcagggactattttcagatgcttgattatggcaagaagaaagaaaagtaacgatttttggtgtaatacaagcaatttgtagattcgagcatacaattttgcataaaacattgcaggttaaaataatattgtaggtttcaagccattgcattacaattgaataattctcacaatcaggttttgtaaaatttaaaactctaagttttgaagtgaagcaataaaactaaattcttaaacaatgacttttaccttcatacaacacagaatagctatttttatttgggttgaaaaagttatttacaactaacattgatcgagtcttggtaaaagtccgataacacatgaagacaaatattaattttccctcagctttctgaaagatcaatgaacatgtttgaggttagtgatattcttaacaaacagtggcaatgctagtctcctacggtggccaagcaagtagtgcattctttaacctaatttgaaattgaaagcaccgaaatacaatttagatctataaaatgggatttgttatttaattctccaccattaatgattaacaatttagatgcagagacacagctaatgaaagaaagttttgattggtgctatttactagttcatttgagttgcctttttaaaatcagttttgtttccattgaatccaagaactcttcataaaatagagaaatatacatatcaaaggacttaagtaaaagtaggttagaaataaataatcttacaacgacattttaaatcctttaatgatttaaagaaaggaagacatataacactgaatgctaaacaggtcttttgaccctctcttgggaatttagatatatattttatagtatatgtatatatatttttacatttcacgtgtaggccacagctgtctaaaatatctcttcatagtaggctagagggatctatcaggagatagaataaaataagatctgagtatagtctcagtttatgagagtatttctttctgctttgacaatcagcagggatcataaatttgaagcaaatcgtggcttttctgcgtctgggtctgtgtttaagactgaggaagattctcttggaagagcagctgctggtggagggggtgctggagggactcctcggttcggggggatggctcccgacgacatctgtcggaagagggtgacgcgctgcgggacagtgctcctgccccctgcctgaaggcccgttccggggaccgccgtcacgggttgagggatggaggccagggactcgcccacagtgggatgaggtctggaaatcagagtggacacctcatggggcagcgagggctgcgaggcggagagtggcctgacttcccgggtcaggttggtgttgtgaagcgcctgcgtgctcttgtgcacttcatttttcggcgtggagctgccaggtgtctgtggctgcggggacggctgctgtggctgagtctgcggcggctgggactgctgtacctgctgctgcggctgctgttgcatgagtgacagctgggaggcggtgggggaggcatagtggaaagttcgagcggccagagggctctgtacaggagggctgcagaccgcggtggtgtaggagcagggtgacaggatggctgatggctggggggtctgtgtgctgggactgggggagtgcaggttgctgtgagacaggctggtcgctgtgtacaccggtggagattgtgtcctcatgcgggaggtcggggtcgtagtagacgatgtggaattcagggttgtcatttgaggataattgatgggagcgattgcctgcaccatctccctgtcatgtttcacaatctgcttgaggatttcgttctcctgattgttgaaaacaccagtgttcagatccttctggaacttttgcagaagaattgaatttttctttcctgtcagcaaaagaaagataggcacttagaaagcctaccaatgactgatgacaacgccaagtgagagtggctcctgcaaacagaagtatagctgtgcttcacaggagaggcttaaaaagccagtcactcacctttacacaccaaataccaatgtggctcctacctttcacacttcctgtatttctctgggaactcttaccttctactcaagttgaacggcctgtaatatggcaaagagccactttacagaagaaatggagatatttaacatgagggccaccttgaagaatgggggaagaaagggcttttggaataggatgggcttggaatcaacatttgattttaaagttactttttcaagaaaggaccatggagacataagcgagaacatttgaacacgtactatgtgataagcactctacaaaagaccttaggtagatgattttatgtaacccgcgaccctgtcagataggtgtgttcataatctcattttacctgaaaggagatcaggacatgagaagactaagaacagtgcccaggaaaacaaaaaaaaaacatggttggcaggtaacagggctgagaaagaccatatacacaaaaaagtgattgcacatccttgctatggaaaatgaaccaactgcccctgtctcatctgtgtgcttgctagaaactcagcctcctgggcctgaccccacttgctgaatcagatgttgcattttactaagatccccaggtgattcccaaatgcaaatctgaggaggactgtatcaggttttgcttttgacccagtgtcttacaccagtcattctcagtcctagttggatatttttcttatctctggagctttaaaaaatactaacatccacttgttccctaccaattaaatctaaataatcatacatgggctctgaatttcagtagtttaaaagcaaatttccccaggaaattctttttttaaaatttattatttatttattttattttatttatttatttttttgagacggagtctcgctctgatgcccaggctggagttgcagtggcaccatcccagctcactgcaagctctgcctcccgggttcatgccattctcctgccttagcctcctgagtagctgggactacaggtgcccgccaccgtgcccggttaattttttgtatttttagtagagatggggtttcaccatgttagccaggatggtctccatctcatgaccttgtgatccacccgcctcggcctcccaaagtgctgggattacaggcgtgagccaccacgcccagcttccccagggaattcttaaatgcagccaagactgagactgactttatgatctttcctcttctgaatggttgttgtgaggaccaagggcatagtgcattgcaggctctcagctccctctaagacctcaataaattttaccttttcctgccatcatcttctgagtggtttgcaatacagcttttcctgccatcatcttctgagtggtttgcaatactagacagtctctggcataataattattagaatgaatagtggattggtgaaagaaggggaaagtagtgacttttctatggcatcattgatacactaatctccaagtgaatatggtaactgaaaagtgaatcaatttgcgatattgctaaataaactaacacattaaaggtaacaaaatatatttttgaagataaatatgtattgtaatttcattgactgctaggaatgcaatcattttaaatgactgccaaaatagttacctctccctacttacagactgtcctaatttcccaaagaacaaaaactcctacattagtaataaatataaatgcttatttagcatatttgcttaactaactgcagcatacatctatatgcaatggccacaaaaccgagaagcataatgtttctttctgattatgtgaacagtcaaaatatcttaatctaagtatctttaaccttgggaaaaataatgtaacttttaatacactcttactatgttataaagatcaaaaattcaattgcttagtgcctattagaaattgcattgcctgtattgattacgaaccatttcatgtaaatattgttataaaaattaactgcaggctgggcgcggtggctcatgcctgtaattccagcactgtgggaggctgagatgggtggatcatgaggttaggaggtcaagaccgtcctggccaacatggtgaaaccccgtctctactaaaaatacaaaatattagcagggcgtggcagtgcacacctgcagtcccagctactcaggaggctgaggcaggagaattgcttgaacctgggaggcggaggctgcagtgagccgagatcacaccactgcactccagcctgggcaacagagcaagattctgtcttaaaaaaaaaaaaaaattaactgcaataagttagatgaaagtgaagctgtatcagattaacagaaattatctagtgaaatatcctgattttaatgttttctctaaggatgtctagctggtttaggaagaaactcattgcttagaaattagtctctgtctctaacataaacactcacacactacaaagagggaagttattttccaattaagtaaggatgccttcaggagtgcctacttcttttgtgggtattgtctccctgaatgagtaggtcttgttaaatctctaagatttcaatatgaatttctaatacgtttgttatatctaatgatgatgtccaaatactgcctttacttctaatctattttcagatctctatgcagtctgctgtcctactaatatagagagaaaggaagatgtgaatgtgaagtgcagaaaaaaagccaacataacaatttatcaatctgaagtccttacctttaataagaatgaagcagttgaggtacctccttgtttatcacaagtgatcccagccccatcttttttgagttcatttattccttcctcccttcctacctctcttcaacaaatattcattgtatactaggtactgtgaatgtaatggtgaattaaacatgagctctacattgacaaatttagcatctctagagccagtaataaaagcagtgctgtgatgggggagcttcagaggctataggagaatgcatccaaggaactgggcttagtagggagtgggaggtcagagaaggtttctagagggaggtgatatctaaacagagagaggaaggttgagcagagtcgagctgaccaaaaaaaagtagagaaggggagggtggcaaagagggtttaggtgtggaaaatgaatgcatactaccttacaacataatgttccaggatatctaggaatgttaacagcaagccaatccaagctaactttactatggcaattatgcaaatcttcaaactagcataactaataaggcctaatggttgtatatatatatttttttatttggtagcagaaaagactttaaaatatgttgatgtttgcgaggtaaagcatctatgtagggcattactatcaaggctttttttttctgcttgagtctatattacaaacattttattatgtctctgctgagattaatttaaatgtgcaaattttcaattcctaatataaagataaaatgtaaagttgatccaaaaatacaaaaaaagtgataaaacttagtttgtaatatagactcatatatcatatttttagttctatttcaatgctatctagaatttttatcattgctttttacctgaagattcaaattgttttggcatcagtcgggaaatcagtttgtttagctagcaaaaatagacattaataaataaacccagaatacttagaagagatagatagggacccagatctctcaagaaatacggctacagctaattgctatttctacacaaattaacaagcaagctataaactggcatgtgggattttttttttttttttttctctgagacaaggtttcactctctctcccagacgggagtgcagtggtaccatcttggttcagggcaacctccacctcccaggctcaagagattctcctgcctcagccttctgagtggctgggattacaggtgcacgccaccacacccggctaatttttgtatttttagtagagacagggtttcaccatgttggccaggctggtctcgaactcctgacctcaaatgatccacctgccttggcctcccaaagtgatgggattacaggcatgagtcaccactccccactgcatttgggacttataattgcaaacctgtattatgccaggagattaaattttatataaagaaggtagaaaactagagtacctattcgatctagtcggtcaatggcaactgtctcaaaggctctcctcatcattggatattcctccaggacctcgttgaaattgtccacggaaagtgagtaaagacgacaatatgtatcagctcgaacactggcagtacgacgtcctttggtcagcaggcaaatctctataaaaacaaacaacaaagaagaatgacttgtttgatcattttcttttaaaagccattaaggcttcccacaacttaaaacaagtctcatggtgtgaaaaaacaattattagcagcattttctattatatcagcaaattccttctgacaaaaatatccgactgccaatactcaatcttaaaataatgtttttttgttttgttttgttttaaaaaaaaaaaaaacagttgagaaggccaggcgcagtggctcacgcctgtaatcccagcactttgggaggccgaggtgggtgaatcacgaggtcaagagatcgagaccatcctggctaacatggtgaaaccccgtctctactaaaaatacaaaaattagctgggcttggtggcaggcgcctgtagtcccagctactcgggaggctgaggcaggagaatcacttgaacctgggaggcagaggttgcagtgagccgagattgtgccactgcactccagcctggcgacagagtgagactccgtctcaaaaaagacaacaacaacaacaaaaaaacatggttgagacttttggtttaaatgcaaggctgaaacacagtataccttatccttcccactccaatcctctgaaataagaaataaagaaaaaaaacaaaaacaaaagagatgcagaaaatggaataaaatgtccacaaaggagttgaaaaaagaaaggggtgatgattagaaagacgattttatgaattctggaaggcagaaagcagatggtataatctaggcagaagccaaaatgagtccaaacattggcttagaaagtcctatgatcaaacaaagctagaccagaggtttagatataggcatgtctaatgtagtttgtatattcccaatgagatcagtatgaagaaagtgatattccacatgtacagagggactctctatttaaatgacttttaagggtaattccttactgaaatttagatttccaaaatatggtaaacaaacatttgcaaatttggatttcattattggccagctgaagctatatagctattaagagataattttccattttgttttccaaaaattatgatttgaactactgtaggctttgattatttttaatttggaaataatttaaacatttagcttcaaaataacaaatttgaaaagagaaatgatagaagtatttctaaaatttagtcacctaacaaaaggaaataaatataatattaaatgtctaaattcacactcgagctaatttaaagaagttctatttatgttgacaaacactgtgaataaatcacgctgtagacacatgtacgttcatttgaatacaatctggtaagaacaatgtcacatatatgcaaactctgagaatactagagaaggacacgtgaaccagtctgggaagatagagaggattttaggaaatgtcacctaaaccatcaattatgctgttgttcttgtcaagattgaaaagtaatgttgtaaacctgctaaataatattgtggggtctgtgtgtttgtctgaatgtttttgtgcctgaatatgtgtgtgtgtctgtgtaggaaaataaatctattttggtcaattttaaagcaaattaccataccatggaatttacctgctactgtaatataaacaaggtaattaaaagaagcattttgaatactactccaaaattaaattcctgtgtcactaaagtactaatgccatataattataatttatgattgccacattatggcaaacaaagctaagtgttggtttcaaatcttgtgtggaatgctaaatgaaagaagacagacatgagaagccacatactgtgtgattccatttatgtaaaatattcagaaaatacaaatctgcagagacagataacagattagtggttgcctgaggcaaaagatggaaaagggaattaacagtaagtgggcacaggaatcttatttgggtgatgaaaatgttctaaaacctgatttgtggtgatggtttcatcacttggtaaatttacttaaagatatttgaattctacactttaatgaattatatgtgtaaaatacgttgcattaaagctatacaaagtgaaaagaaaattagttttgtttttattttttatctttatacttattatattttcatttgaatttattttttctgaactctttctctttactctggaaacattgttttgtctctttttctaggtctttctcttgtgtgttgaatgttttcttttggtaatctattgatgtccaatcacatttaaagataaaaaactctggtaatgttgcagaatttgttaatttaaagtttttcattagggtaaataggcggggagcttgtcctcatatttctctaaataccagaatgaggagggctttactctaggccactgacatctctcttaactgtcctagttctccctctcattcaattgctttatgaacgaaccactgacatttccccccactatcctcaggtacatggttggctacagactattccgcaacatggagggagggatgtctcatacctaccatcagcataagtcacccgctttctgttctgtcttctgtggtcctgttgtctcttaactaagagcctgtttagtattcttccaggatacctgctgtctccttggctcccgttctttgtacgtatattccatgttccctctactttcccttcaaggttcatcagtaaccaccagcatacatttaaatgcaggctacagaatacctgaatagcactggtttatccaatacattaatgtcattatattacaaaacaaaatttgggagtaggcaaggccagcatttgttcagcacttcaatgatgccaaggcactgtgcccataatacttttgttttccttggccttcttctcatgatcacaagttgatagcaacaactacacacattcatatactcacacaacagcatccaaagtttggggagacagcaaaagactttcttcctatatttctttctttttattgtgaaggcaaaagttgtactacaggtccctaacttactttctctggcattttattatcagaactgcatcatgtggccagccttagctgcaagaaaggatttaaaacggaatatttggtaaatcggaataaggtaactactgttagtgattgagttaggtaaatactggtttaatccctgaagtagtatatgatgccagccatacaagattttattaacaagaaagggccatggttgctggctatggaaccaatgttatctggcacttcactcatatcaaaagtattttctgtcttctagaaacatgtccctttgtctcgtctcctggttgctcccaaatacaaattcatgcatcaggttactttgtggttgagtttatattttattcttttactattattaattgggtctctgtagagggatgagataaaggcatgtcctgggaatcatcttaaataagaaatgtatttgtcttatgcttagaaattacttggaattatttttacaaagagcatgtgtttatatattatttttaatttttaaaaacaagtttaaaaattagaaataagaatatagctattctcagtatgcacagtcattttacagatatgttaaaaacagatttactggagcatagatataagtttagtcaaattttttctaaaccattatttacaaatgattttctggcctctgtcatctgatgatctcatataatgaatatataacatatgtagcatatgttacatagtataggtacacattactaagtaatcatggcttgaatcagttaaatattaccattggtaagaaaatcttcaaggaggatgcttttaaaatactgtttaaagcctacatgaagaaatgtgtacgtgtgttatgagctcttaacccaaaggttttctatgttgccatctcagtaaaacttagatgttactgttcagcaaatcttacctcttcattacattttgtttaaaaagataatgtacttattttaccttttgtagtttgtgggatcaacactgatattctaatttggtctttcttgccagttaatgaggtagagtgctgtttggggcattgtctacagcagtaatgtctggtttcctgctgattcaggtacacacacacacacacacacacacacacacacacacacacacagacacagttgcttgggctattttagggattctttttttggtatagtattggcctggggatttagagtcctgtgttagtctcagtcaacttgctcttgtttgtgagaattagacacccatttatattctgtggagtttatttatcagtgaaaagtaaaactcaattatgtctctagagttttattgtccttaactctgtaactaacttagacttcattcaacattttatctgtaaagtctcattaatctttatatctccagtgcctacatgacagatagtaggggcttaatgttagctgacttgaataattgaatcaaatagcaacatgcttaatgaaataaattatttaatcacctacaaaaattccctttgtatttaatgtgacatattcccctacggagcaactaagggctaaatatagacttgcacaacaaagtcccttcaaaagttatataaaggactttgttcattaccaactcaaaactcatcagccattaccttgctgcatgtcctcaataatttcttagtgagaaaaagaacaactgaaggttattcatgagaggagaaatagtcattaagaagtatgaaaaacacttaaaataatctcttcttttaaagcctccatactctgtttctagtatgaataacagaattaagaaatggcacacccttagcaacgaaaaaagagtaaactttctgatcaaagaggcttagatttcatgaattgaatgtccagattaattttctcttgatacaatattaagctattttgaaaatctacttattgagtaaacacagccctttgttaggtgttacagagttttggtgtatttgccatatctgtgtgtatatgtgtctttggcggggatggggggtgtttaaataaaggatatatatagaaaaaaattagtcatctgtagctcatactatcctttaggtaccttagaaattatgtatgtattagtttatcactatttcattttattttattctactgaatttctgtttcctaaataatggctttatcaacctagctggtttaagacattttaaagacagaaaccatatagttaccttataatatcccttatagtgcctgctacattgagtttccagcccaggcaaaatgatttaaaaatgcttatgcataccccaattacagtgaataaacataaaacccacactaagttatcttcttaagttttggataatattggttcacctgttaggcatcttcccttggtcatagaacttgccaaatgttttacgtactttctttgaggaacataacatatctctgaggttttgtgcaatgtttataataaagaaaactatctggaagatttggtcatttttttttcaatgtagacatgcctttactcatcaggaagaaaattaacctgcttatagatatgcatgttgatttcataaagcaaataaagttaaatacaaaataaaataaaattggactcccaaagaacagattcagtgcagtttacagatgcaagctttttaaagattgtcttggcatactttctagaatctgtctgttccagcctttctgcttttttcttgtttgtatactctctgagagctcaactaagaacttcccagtggtgtaataactgttttaagaatcttagtgcaaatttacttgggtaataggtcccttcatctggatgcgtatttacatattataataaattgtaaaagtaatggggacttagcgtattaattttaattcggtagaattttcctggttttctttatagggcgtttatgaatggctaagtagttatttcacctagttaagatgaaaactattggtaatgcatcctgtataggaacatagacaactctgtttccaatttcagtgtcagaaagagtgtggcctgggagactagatttggcctagcacattatttgtatacctttaataatccttaaggtatgagatatatcaacttctcaatgctatttttgctggcattagttaaccctgattataaacatttaagtccacctgacattactgtcacctacataaacagtcatttttataaggtagggcaaatggcttcaaacgttttgcaactcagaaatattttcctgacctctaaaactgaacttgacattgctgtgacacagagctaatcaggaactcatgacagaaatttctaaagtaatgtgcttaacctgagcttctagaattttgggcaaaactgtacttagcttctcatagtaacctaaacaaaagctgcttccttctttagtaactgataccatgaaataaaagtaattctctgctgtgcatcaaaatactaatttcctataaattatttagatttctaattcactgtgttataataacatgtaacagaaaatatcacttttttgctttctttttgtctttgtagactttctgtatttatattagtgaactagtaaaacactgcctctgtatggcacaggaaatgataacatctggcttaaatcattttgcgtatcatgtttggctggtagaagtactctgggtatcaaatagatttgaatagaaatcgaaagaagtttagactaggaaagaacattaaataggtgcaaattttttagtatttgattgatttcttagtacagtactttaatgcatttcacattttgtacaatcttctgaaaaagagattgaatacaacaaatttctaaatatagatataaagaaggtattattcatgtatagattacatattataatattctaataaccagaatacccaatttttcattttactaagggtataactagtcatttcaactcacatagatacattcctaattgcacaattatttgtgtcctcttctactactcatgccctgttatttatggttatttagatcaaataaagttattgttttatcaaacaaatcttagctccaagttcaatcaaatcatctctcttaaaacatataaattagagtgatcacgtgggcctctgaatgttgacctagtagcaactcttcagacaagctatgtgttagcaaagttattcattgacaaagctgttatgtggttaactaaaacagtgcctgtaaaagagtgcctataaaacagtgcctataaagagtgccaccacaagcctggcacattgtgggtactcgtaaaacattaatttccttcctttttccccatttccttgtattctaatttttccttatgattttgatggtacctgctagaagcaaataaaagtaatgcttcacacatcaagtagctctccaaatttgtgatatataactatcatctttcaccatctcataaacaatttgttcataaactaatcatacaaattccttagactgtgtcttgaggaagatggtttcacatccactaatactctttcttaattgtcccagggaaaatttatctttgtgcttcctctgtatcttgatcatcttgcatcttagttcctacattattggacttacttgtttataatctttatactaaactataaggtctttaaaggaagtgcaatgattgcttttgcaatgtcatcacttaccaaacattgtcatatattatttgtttcaagaaatatggaatgttgggaggccgaggggggcagatcacttgaggtcaggagtttaagaccagcctggccaacatggtgaaaccctgtctctactaaaaatacaaaaaattagtgggtatgttggcaggcgcctgaaactccagctacttgggaggctgaggcaggagaatcatttgaaaccaagatatggaggttgcagtgagctgagatcgtgccactgcactacagcctcggtgatggagtgagactctgtctcagaaaaaaaaaaaaaaggaaataagtgaatcaatcaataactgaaaatggcttacatcagattaaaaatattcttcataaaacaaggtgctcacatttgaatacaatataccaaataggcaaatctttttgtgaagctttggctccaattgacagaagttataatacaaagctctcatctggttcctactaatcataaacatgtttgtaacatgattgtttgattttgttgtatatgtgaatttttgaaattaaggtttacactttctactccttaacttctctccctttcctcttctttatctgtgtctttcatttccattgtaactccttcagcttgcataaaatcagctttacataatactgttggtaaacttatatagaatatatatttgtactacttgtctttggcaagttaaaatacctaatggatattactgatattacagatatgttacgtaggtaggaaacaatctcaggtagccgcgtgttagcccatgtgacataaacagattaaaggggttctgttttgtgattgtaacaaaaataacataaaaatatcaaagctaagaagggtaaaaccacaatttttctgcttctatctgtctttaaaaattcaccagaccattccaaattgtccctttcaatctttaaatctagcagcactcaagtcgtcaaaagttaatcaaacaccttgaattataaatgcctttaaaatgcagccagcttttaaaaattcatcaaatgatttttggctcttaggtacctccaatgtgttttttgaagtaatatcctgacagctctgttttcctatgtggcttaatatgcttctaaaaaatgaaaaaaacacgtggcagaaacaatagtctccataggcaatatattcaccagatatttatgaggcaagtctactacagcctaaaaggttatttgtctccaaaatatttcccttgatgctctctctttctcacacacacacacaccacatgcacacatgataaaatcaacatttaaacatgcatttcctctatttgtttaatgcaaaaattcattcattcattcagaatggattcattagtgcagtgtcacactttaatatgtatgggaatcacctgggttgtcttactgcaaagcaggttaggatttagtaagtctggagtgggatgaaagaatctgcaattctagcaagggataagtattaccactgataagcttcttttgggtaatgagttcatatagctgtcagatttataatttaaaaagagttcctcatttagaagaagttggaaaaagtaaacaaaaggaatggaaattaaagataacatgaattcaagttaaccaccattttccctgcaacctgtaccttaggcaattgtggagaatacaaaataagtatattttgtatccttatcctgactgaaagagtcgagaattataaattcaagcataatatgaaaaaagatttgagcataattccaaggctaaataacctactagagactttatgtaaattcaaataatatatcattcatcatagagtaattctgtacatcattggtgacatgaagggtcttggttagacttcaaaaaagtgtagaaactacattacacaaactatggggatgaagaggacaagagaaaaggaacaggaggggagaggagacattagaatgaaatagtatcatgatacaggttcaaagaaaggtttggaagctaatttttatgaaattttggaagagcagcttgacaggatcataagtatttgattaggcatagagaatatttctccatgggtaagaaagttagtcctggtctacactattattttagggctcttcaggaaaaacttcgtgtgcaaaatattattttaagaaattaacttacatggaatagagtggagagttctagctctctacatatcttgccatttatgggaaagatagttagcctctctttctccaacaggtaaatttgttctctcaaatcttttgcttcataatacaggcatatttatctatagtcagtttgccaaatgagctggaagggaagtttttagtaaagaattgtaaagaagttttgataataattttggggaattgattgatctaaagctgtagcactgacaacagaagtagtctctctaaataatcactgtaaaatgaaacttcaacagagcttgaaaggggatgaggcatccatgattttgaacctaaacataaacaaaacaaaacaaaaaaacaatgctaggctgtgtctgtcctaggagtgaatataagataaaagattgttttgggaacaaataaagcaaaacttttgcataaaaaaactaatttcatgaaactctttctcacattaaaccagttattcttttattaaaaaatgaaagcagtatttgtgtgtgtgtgttttgtacaaattggaaagcttttctcatgtgactttaaaaatctctgataactggttcaaccaggattgatgcttactccaaagatggtcatctataactcaggtagcagcccatacaacgatctggctggagaactctttcgatggggatgcttcaatcagactgtgactaatagaattaatcatacccattgttggggagatttaaagtaaagaatgaatagctagaataatcagagtgcatgagttgtgagaatgataaatccccaaagtggtgttgggccactggcatcactgtggtttcctgatggacaatctcacttgccataaagtctgcctctaatactcctgagataatttcccttgcttcttttcttcctgtgatcccttacagtgcttcttttcttcctgtgatcccttacaatgcactctatcatcagttaatctgatctttactttgtgtcatccccctgagtgcctgactcatacacatctctactcgtgacctctttcaggtccagaagttcataccagtccattttgttaagagcctctaccttttcttttatttccttcactcgatagattacaatgagttcttcaagttcagtatgtgagtagccacagagaggtcttgaggtaagtagaaaactaatatcctacctataaagttttcattttctacttttcagtaatttgaagtattcatagaggacgactgggaatcaatctttgtgcaagataacagaaaaaatttattaggcaaataaagaaatcctattaccactgcccaatcaagaaaacattcacacttacaaatcaatcctaacagaggtaaatatctgttgatttttttcccactccaagaaacataattctatatgaccactaatgagcaaattgaaagtaataattacaatcataaaaatgccactgaggttttgagtttaaaaagtttgtatgtaagcttaagtatgggttgataagaaatactaatccacatgaataattagttactttagttagtagtatgtgttaattgatagaggtagaatgcatatacattaaagcaatgataatgataagaaaatatattttatagaatgttttttccttatatatcttattcagaatgagttaaatttggaaaagaggcttgttttgaacagacgggttagatcaggagtcctataaccaaatccaaccattggcttattgaactgctttttttaaattaagaaatggatttacatttttaaaggtttgttaaaataaaagcaaaaatgaaagatggatatacaatcatatatggcttacaaagcctaaatattaactatctgaacttttacagaaaaacatttgcctactccttggttacatacatttttttccttacaaatagatgtcctttattgaatcttaacttaggcaaataaaatctggaaagaacagaaatcagcagactaaagatgtataagccactatttagcttgtgactttaagcaaagtgaagtgaggaattaggtcaaacagtccaacaggttatccaaactacatattatcttttatatttaaaaaagaaattctctctgactcatttggtcaacatgataaaaaggacaccaggaaatcctcccaccaaggggtctgcctttcatccaggagaaaagacacacactcattgtttcaaagcttaactgaggtgtgatacatcctgttgaaaccgtgttcaaagaagcctcatataaccagaaactcaataaaccagtattttatttccatatttgagaaggataaggatgagaaatgactttccaaaaagataaaagttacaaaaaagcagatttttcctatattttgttaatgttttattgcagaaaattgtaaacacataaaagtaacaatatactatattactagaatactagtagaagagtataaatctaacgaattagtagaatagtgtaacaaaataccataataaaatctcatatgttccttgctcagattaaacaatcatcaactgatagcttgtttcactggtacctcatacatttccacctaattattttgagaaaaattgcagacatattatttcaaagataaaatttcagtatgcatcactaaaatataaatattcttaaaataaaaatgtccataatatcaccataacacccccaaaattaatagtaatttcttaaaattatcaaatacttagctggtattaacattttttaagcaggcacatattttgtaaagaagttatttgcaggtcatgtcccaactccctcactttcctgaggagtctaaacaaaaacatcctctagaactataacacttaaaataattaaaaataagctttgaaacatgaaagatatataatttattataataccatatcaggacaagaaaattctactcatgtatttcaagaaaggatactagccaatttttacagcatcaactaaaaacaaaaaagaattttgctgttgttgagcactagcaaaatataactaaaatactctagtcctagaatattgatttatcaagctgtatatttacttactattttgcatcatcatcactatcatagcagaaactcctagacagaaagatgaaagacaactggaatttcggaggtcaagtgagaatgaaggaagacttgaaagaatctcagaagaaaaacaaaataaatgcaaagagaaatcatctgaatgctatttgactaatattaacttctccacttgtgttccaatatataaaactgaatgagactttctagactagggtttctcaacctcagccctactgacattttgggccagataattttttggtgtctggagttgtcctgtgcattgtaaaatgtttagcttcatctccctggcctcaatctactggaagccaatagcaaactcctcacactgaaagtaccacaataaggactgacaggagtgctcatgaggacatatttttggcctcctatcttcataaactctgctctaataatccaaggtgccaaacatgctcatgctttgtgtctttgtacaacttttggatcatatttacaacagaagcttaaaattatgttttagatatcaaagcatctataaataaactttttgggacatttgctttaattatgcaatcttttttggatactcttcttggaacgttgtaaagcaaatgctaatcactttgttcatgagagatagctatttaaacacattaaaaatgcttttcaaaaattccgtctatttttcttttccattcaagtgtcaggtaactccagttggtttaccagtttaattaaccaggataaaatagatttctgctaaagaatctgtggcatttagattcagaggcaaaaaaaaaaaatacagaaaaataaaatttacattactgttaataaatagtatcatgtgcaaattgtttatgacagacaaagtttgattcggttggaggtttttgttagtatgttgatatggtttggctctgtgtccccacccaaatctcatgtagaaatgtaatcctcagtgttgaagaggggcctggtgggaggtaattggatcatgggggtggatttcccccttgctgttgtcatggtaatgagtgagtactcaagacttctgcttgtttaaacgtgtgtattacttcccccttctctctctctctctcctgctccaccatgtatagtatgtgcctatttcctcttcacctttcactatgttgtaagttttctgaggcctccccagccatgcttcctgtatagccatcagaactttgaatcaattaaatttcttttcttcataaattacccagtctcaggaagtttcttatagcaatgcaagaacagactaatacatatgtgcagacaaaaaagtatttgagagcatgcagacaaaaaatatacaagagctcttctcttctttttttttttttttttttttttttttgagacggagtctcactctgttgccgggctggagtgcagtggcatgatctcggctcactgtaacctccgcttcctgggttcaagcaattatcctgcctcagcctcctgagcagctgggactacaggtgcccgccaccacgcccgggggctaatttttttttgtattttagtagagatggggtttcaccatatttgccaggatggtcttgatctcctgacctcatgatctgcctgcctcagcctcccagtgttgggattacaggtgtgagccactgagccctgccaagagctcttctttttggctagctatagtatatgtttagtggaatgttaaaagattcacatacaaagatattctttcatattgagccacacgtttaaattttattgacttttacactggtacaaaagcacatagattatttattttggtagagaaaactgaataaaatatgcccaatactgtcacataggactatcaaatatcattaataaattttgcaatatgttttccaccatataatgatatgtatataagtttaatggaaattccttcaatatttctttagaacaccacttagtaaagcattgaaaactactttgtagttacattgacaatattgtttcatttgtgctccatgtgtaaaagaaatgggctttaaaaattgttttcccaatatcaatgtaaaacatgttgttgttactggctttcttatatgttatcttgagtagaatgttgccacacaatatcttgaaaatacattgaaaagtattaattcaaattatgtgtagtgagtggatttagggtaaagaaagtttgggtcataaaaacaatcattctgtaatttgctgtctagctagatatagtacaagagttttcctagccaaggtaaagacaattcttccccaaacttgaattagtatctcatgaccattcacatttggatgctactgtcagtggaataaatttcaaattccttaatctggctttcaaaaccatccataatctggtccgatttcatgtttccaactagtactgtctctaattacaatctcaaatgctccatttcaattcagcaagcatctacttagttccagctacgtgcttcattctgtgttatgggaaatataccccgtaggactaactagtaattctttcaatcagctccagtaatgctcttggtcattcttttcttcagtgtgtagtgtgtatttctctttacagaaaccctattcttaaggtcctctacatacctaaatatcatcatttattgatttaaataaaatattagttgagttgacatgtttgtctattttttaatctcttcacttaatgtgtaatcttttaaatcatcagtaataaaaataaaattaagctttgtaaaggtaattacaaacttgtactgcatcctccatatctgaactgggtctaagaaagttcctactttccccaaatgaatgtgactttatgatgaacattgccatggatgaagatgaaaatatactttgatagcatgttcgaaattattaaagagaatagtataaaatgcacaagtattttctatctttaatctttattatacttgggaaaccaacctatgaaatactattcttgatataggaacggccaaatatttcatgacaaagatgccaaaagcaattacaacaaaagcaaaaattgacaaatgggatctaattaaacttaggagtttctgcacagcaaaataaactatcaacagagtaaacagacaacctacagaatgggagaaaatttttgcaaactatgtagctgataagtctaatatccagcacctataaggaacttaaacaaatttacaagagaaaaacaaacaacaccattaaaatgtgggcaaaggacatgaacagacacttttccaaagaagacatacatgcggccaacaatcatatgaaaaaagctcaatatcattgatcattagagaaatacaaatcaaaaccataatgagataccatctcacactagtcagaatgtctaccattaaaaagtaaaaaaataacagatgcaggtgaggttgcagagaaaaggaaacacttatacactgttggttggagtgtaaattagttcaaccattgtggaaagcagtacagtgattcctcaaagagctaaaaacagaactaccattggaaccagctatcccattaccgcatatacaccaagaggaatataaatcattctactataaagacacatgcatgcgtatgttgattgcagcactatgcacaatagcaaaaatgtggagtcaacttaaatgcctatcaatgacagattggataaagaaaatgcagtatatagacatcatagaatactatgcagccacagaaaagaatgagatcctgtcttttgtgggaacacagatggagctggaggccatttcccttagcaaactaatgcaggaactgaaaaccaaatacggcatgttatcacttataaatggaagctaaatgatgagaactcatgaacacaaagaagggaacagatactggggcctatttgaggatagagggtaggagagaggaacagaaaggataacaattgggtattaggcttggtacctgggtgatgaaataatctgcacaaccaatccccatgacatgaatttacttatgtaacaaacctgcacaggtgcccctgaaatgaaaataaaagttaaaaaaattggcgctcattgaaaatggagaagattttaatctgtaaccctgtaacccctttctttcctaacaaacatttttgaaatatcttagaggtaaatgattgcatttatataaattgcagtaaagatgaaaaataagaggaaataaaacaaaaatatatttagttaatagctaagtaggagcaaagtgatccaatgcataactccaaggagacttagcatctgtgcactgaaatgcttgttttaacaagtccaactgtgttttctaactatgtcaatcctctttcccttggctagtgcagaatccagtttatagaatatatcaaacttcagccttcttgctgagaggagctgaatgctgctttaatttcccagccgggagctggtatttcagcatgaaccaggcatatttaattgttgtgtaaatgttaagatcacaatgtaggccatatggcagtttctctttacagaagaagagagaccttcaaatcaaactgttaagtctgagaaccatttgaagtcacagtcattaatttggagatatggacaagagatttatttctcttttctatgtgtttcttcctccttcctatgcaccataagagagatgggtctatttaaagtggaaaaaacaatgtaggtcaattctattaaactctaagtggaacttccacaagtttctatttcataatggtgggggaaatgctactttaaaatcaattttctaagtccatattagggtcatgcttcactttggaatgagctggagagattccagatcatcagaaatgagtttcctgaggtgaaggagcagaagtagctccatataatttttttctttaaaacaggtcacattttccttcaatttgccatctccatctcaacttttctttgacacactactattcaatttttacaactcagctcagaagtgaggtgggtactcttagggccttgaagattttgtttaggcacaagtgggccaatgcacatggctaatgcaaagaattgaacaataaatccaaaatatctttctaaaatgttattctctgtgctggaaatacaatttcacatcctctgcggccttttctcattttcactcttcttatattattatagacgtctcacttggaagctggtgggaactaggtgtattcttaggtatttctgaggtcctatagacttagacactttcgaagcaataaatctcatttggatttattaagggtatttcgcttaaacattttttactgtattcagccctgagttattaaaggtatttatattttggcatcttattcattttcatggtccctgagaaaaatttcaagattgttatctgaaaaatgtagccaagatcaatcaccaccagtttctgtcctcttcacgatttcagtgaaaaaagatcttgatttaaagatgttcctaattgactaatgatggcaggaatgttgaattttgttttattttctaggaccatccatacccccttgcagaactggaggaagtagaggtctacatttacacaaaaacatggtaactgtgaccatgaatgattcagaatgacccaggatttgttctgcagcaccttatgattatcttataaacaaatcatcagatgtttgccatcagttcctcatcttctctgataaactttctttatagtttggggagacaaacacacacggaaaatttgtttttaaagaacttcagagttaaggaactaaaaaaaaactaagtttctaagattctcagaaactggaaattaacttttatttagataattctgtttctcattatataggaaaaagttgacagatataggagacaagacatgggagtattattttgtgtcttctctcagtggcaaatcgataatgataataatgttatctttacctacttatatggtttaaaaatatataccttattagaaattataagtgcaaacattatatcctttctgttctccaagttataatagtacatgcacaactatgaatattattatgtaaaaatgatttcagtatttaagaagtactagaccaaaaatttccagtttcttgaggctggaagcattggagattgctctgtagtaacaagtatcctgtaaacttcaagaaaataagaacttttaacatatttcaaatctttacaataagaggataaatgtgtactgaattaataagtccaccactgcattgtaaaatgaatgcaattaagattttaaaggctatttctaagaagtgtctgatgtgttttagtcttcatctttctcactcatgtccaatctgactgtattattgtcagcgactatcaactgacttgttagtattgaaaatattagacacatcttttgagattctattcatttctttggggtacaaccacatatccaagcaaagggaactacttagtgcataccattaaaacattaagatgttgttgttgatgtgtttctcttgtaacatatggtatgaggtacaaagacaattttaaaattacttctggcattttaaattttcaaaggacatcccaataatgtaagtttaatatacactgaaaaattggtgatgaaacgcaatttaaagtgactaaatgttttctactttattattttttgctgaactgttctgactgacaattttattcttcccatgtaagtaaattcagccatggagaagtgtctccatggataatagataggtcagaacagtcatacttaattgaagtatgcttagaattattaaattcatattatttagcaataggctagaaggtatgcgtgtgtgtgtgtgtgtgtctgtgtgtgtgtgtgtatgtgatgtgttttataattcaatagaagtgggaagaattcttattttctgaaatgttatagagtaacattattggtaacaatgttcagaaaatttacctgttactgtaggaagagcggttacctgtgagtgaaagtcccagccctgtcaccaccaacctctaggctcatacatttctcaggctcctcattcgtataagaggattagataatgaataagctccctctaattctaaatttacaaaaatgtttatgaataatttagtgtatgataaatatatgccttccattttacttctaaagcatatgagaaacataccaaaaatgataaagattatatattcttgtagttattttaatatagctgagttatgtaatacatatggaattacttagcacaatgcctggcacattaagaactagttgtttgaagagtttggattttactaaatcctagagtatgatttcttatgtgtgtgctcacaattcaattttgtttatagtgaggaaattagaattttcaaagttgaggttatctctagttttaaaaagctgtcatgattatttattccacccttacttccccaccatcagacacacacacacattgatatagagtcattttcattgctataggattaagactaacacatagtcaggagaaatacaaattgacaattagatctccagtgttgattcacttgacacgagccctgaatcaataatgccccagtactgtcttttacacgcatctactgctttatactacactggccctttcgcttatgctaatgcctaacatcatggcacagactgtgccaggtactgctctaagtattttagaaatattggatcatttcatcctctaagcaaaccctagtgaggtaggaattaacattattccagttttacaggtttggagatattcttggggaagatctgtggctttcccaaggtcaaatagcatctcagggtgcagctgcatcacctacactcttaaccagtatcctctcatctcccaccacatttcaaggagcttcacagtccaaggtctgacaatttctactttatttcactatccacgaaaaaaagtggcagttattttttaaccaccggagcatgaatcatcacaaatctcacctacctccatttctttttaaattgctaagtgcttggccttgaaaacactcacagtgataatactacaaatgaaatgcagcccttctttaaaaatactgtgaactagaataggcaagaagacattttggatgtttcatgccaaacaacctggcaaaaaagaatacacccttcaagagtcccattctaacggaatcattggtctgaaaggggctgtagaaagcgtctgtcttaataatctcattttacacatgatgattctgagcccctgggtgttacacatgttaggtcctatctacggaaagaaaactagaacctggctctgtggatgctgagcacactgccacatcatgctgcctcctaatccttttatagttttgattgtaaatatataatttagtaaattaatttgcaatattatagaaagaaagaatcaggcattaaatcgtgcttaggttccctagacataacttgtaagttgcatgtggtgcatagtttagtagggagaatcctggtaccattgcacagttctagcaatttggacctttggacttgaagggagggtctaaatttaagagtaagtaaaacctgggcatagaataaaaagcttctgttattagcacagggggaaggccacatgggaaaggagcaagctagagacagagttgaaatgagaacacagtgagaaaccagccatctgtccaccagcaatgaagcacacaaagtaaccgcaggacatcattgccttccaaatgaacctattcatgtagcagattcctaagatcagtcctttactcataagctgtgtttttggggggcattatacaatataaccttaagaacattttaaacctaaatacctcacaatgataaaaagcccattatctttcctatggacatattaactattctttagtataaaaatatgacttagaaactgaaagatttttaaattgcttccaaatgtatacttaatgcctcacaatgtaacacttattattcatacagaaagatggtattacttcaccttactttactttgggctgagaacagagaataaaaaaggtgagtggagaatgaaagtatattaaaaataaaattttgtaccctggttgctttcatgcagttgtacttgcatactttgttgaagtgtgccttctcagagacatttatgtcacttttgtctcctagactccacagatacaatggagcattataataatccctaaagaaagtaacacaacagaataatagtttgcacaactttatccaaggaactcaaagtactttattaatgttagctcattaatcacaccagagtgtggcaaaggatgaatacatctgctgaaacagggcaagagcatcttactcagcaaagttgtagtgagactcaaaagtcaaatgggaggctggagagcaaatatacaggcacagaaaaagaaatgatgtcaaaggaatcttcttattctattcagcactgtattagttcatttaaaatgcggtaacaaattactatagagtaggtggtttatggacaacagaaatgtattcttacagttctggagcctcaaagttcaagatcagggtgccagcatggtcaggttctgatgagggccctcttctaggttacatactgccttctttgtattctctcatggtagaaaagaagctggctggttctctgcctgtttatattggggcatgatatggtttggctgtgtccccacccaaatctcatcttgaattgtagctcccataattcccatgtcctgtgggagggacctggtgggagaaatcatggaggcagtttttcctgcactgttcttgtgacagtgaataactgtcacgagatctgatggttttataaagggcagttcccctgcacatgctgtcttgcctgccaccatgtaagacattcccccacttctcctttgccttctaccatgactgtgaggactccccagccatgtggagctgtgagtccattaaacctctctttctttataaattacctagtcttgggtatgtcttaattagcaatgtgagaatggacaaatacagggcactaatcctattcatcagggttccaccctcatgacctaattaccttccagaggccccacctccaatgtcatcacatttgagactacagtttcaacatatgaattgtaggggacataaacattcagtccttaaaaagtactaagtaagatattactgaaacactaagtctaattatttggtttacatttatgacttctgttaagaatttgtagggaaaacaaaataaataagacacttttgtgtttaaaaattgtaaaaaaaagacaccatttattagaagaaaagtttgggattagttaatttaattttataaaacttattcaattaaaggtggctccaaaagtagatccaatgctaccaatatttactcagtaaaaatcatgtgttagtcatgatgctgagggtgcagatacaaacagaaacataacatgatcttttacaagtctacagtataatgggaatgttatagtctcatagtttccatatatcttttatataaatgctgcaaataatcatgaagaaacaaaagagatgatgagaaaataaggaaaagactataaataatatatgaaaggaaaaaagaatcttaaaagtacagctttaatttggtttcaaatgtctttcactgaaatataggttattcttgtcataataatgtaggcatatactcattgtgtccatcagaaagcttgaaaatgcttcataaaacacaatggcctaagtattatttgattttctcactatcaccatctttcatattttaatttttattcagccaccgaggtcatatcttagactttgttatcaccaatagcttaactaattccaaaacctctatacagatcatttcttctatttccagcttactttattctacttctctacctccaataacttttctctctcatatggacctgtagttcattaactctactctttattcactgttcactaccttcccacatgaagagttcttggtctatcactaagatgatcaccttataaatatatcatgttctgtgtatgcccactcgttctgttttctggacaccacaccgagctcatcttttataaatctttcaacctatctctctggtttagcaaagctggcatccttttgctcttggaactgaccacctctgttttcacttcaggagatttgcacttgttattccccatgctgataacgtttctccctcagattgttacatgactagctttctctcttttttattttatttattttttgagacagagttgcactctgttgcccaggctggagtgcaatggtacaatcttggctcgttgcaacctccatctcctcaagggatcctcccacttcaggccccccaagtagttgtatgtgctaccacatccagctactttctgattttttgtagagacagggtctcactatgttgctcaggcttgtcttgaactcctgggatcaagtgatcctttagcctttgtaccccaaagtgccgggaatacaggcacaagccaccacatccagtgctgtcccttttcattaagctttctgcccaaaatattcttttattaacttgctttattattttttatggcatcaaatattatttgaaattattttatgtatacatttgtttattgtttattttatgtcctttcaatagtgcataatatccatgaatgctagaattttattttattcactattgcatgacacaaatttagaatactatgtggaatacagtgtattttcaatatccatttgttgaagaaaaaaaaggaaagaagaaaggaatgtaatttatttgccccattcctgaaataaatgaacactcttagggatatattgggcttaacatggaataacaattttcatttataccattctagatacaatttccttgcaaatctccattatcttaatcttacaattgataactattttgtacaatatgctgggcactagtcaaatatggctattaacatttaattcaatttaaaatgattataataaataaaaccaaatacccagttcctcagtcacactagccacattttaaatgctcaactgctatatattgacagtggctagcttttttaaccgtgttaaatttacaacattttcatcacaacagaaagttctgctagacatcattcctacagattctattgttttagattctaggactatattatctgatccctaataaagtgagattaatttgaaattagaaaacaatttaaaaggcataaactctgaatttctcagaaatcatctggtatgtttcattaagtttagattgtactttatcattatcatatgtataaatttcctatcttcaaataaagaatgagactaacaaaataatattattctcaaagaatgagaataatattaaagtgaatgggatgcttcactacttttctaagtttagagctggtgacaaagaagaagaaataaagattaagagcagtgacaaagaaaatatatctatccattcatccatcattcttctacccatctactcattctttataaatgttcttactgagtgttgttcacacactgtgctctggttttacatgtttaaatttgaagaaatcatagtgtttaaactcagacaattgataaagtaatattttaaatttacatatgaaataataattgaaataattcaataataggctaaatgctatgaaagcataaagagaaaatcagtttacctaacaccagcacaaagagatgaaaacacatttgaatgtatgtgtctttataacagaacaatttacattcctttgagtatatacccagtaatgggattgctgggttaaacggtatttctgtctttaggtctttgaggaattacaacactgtcttccacagtgattgaactaccatacactgacatcaacagtgtaaaactgttccttcttctccacaacctcaccagtatctataattttttgatattttaataatagccattctgactggtttgagatgttatctcattgtggttttgatttgcctttctttaatgatcagtgatattagccaggcatggtggtatacacctgtagtcccagctacttgtgaggcttaggcgggaagatcacttaagcctagaaggtcaaggctgaggtgagcctgggtgacagagcaagacatggtctacaaaaacaaaacaaaacaaaacaaaacaaaacaaagcaaaaacctctttaaatgtggtcctttgtgaactagcacaggaatataggaggacccaggattgtaatatgaactttttaggtttctccttcttcccctccttctctttttctattttattaaaaagagaaagacattttgacttcaaaataaaatgtcttcttaatgttcatcctaattttcctaagtatgtcagatatttggcattgattcatttataaatgactttataaagacacagaactctgaggtgaggataaagtgactagcatctctctcacacaatgagttagcaaagcttcagcttgtgattgtgtattatttgacatttctaagtcagccaagacctgacaagaaaagaaaagatctgacagagttgtcttaccagcatggacaaaattacttcatttaccctcacctaagaggataacgaatgaggaaggaaaagaaaaattaaaaaaaactccataaggagattaatcgttctttcctacggctgcctcttcttcctgctcctcataaatgtaatagaaaaaattgagctaatcaaattgttaatttgattaactatcaacagtttccttatgccttctagaaaaccagcatgaggttaaacaaatataatatagaagtagagtaaattgccaactgcagattggcagatgtttcagtcctcttagagttaacgaatagtcacggtgaccatgattgcctgtggttttttcgaatcggtgtctctaaatttaaaaatgtcaaataatcattatctgcccaaatgtattttggtcataaaaatcctaaatacatacattaactctgtaaagtatctgccagtcccttcacagcttgcgaaatgtccattattaaagcagcatttaacaacagtcatgaaaaatatttcctttctcatgggtttgtttcacattatcattccataaaaagaacttatgggacagacattttgaaagaaagaaagttaagagactgaatcaattagaacactttggcgtggaaagataaatgattgttaagaggtgaatgagtaaaggagatattaataataatcaaataaattatattagaaaaacaaacttttctttaaaatcaaagtattggtacaaaggtatattatttgacattttaatatggtttgttaatggcattttacttagtggataatatatttacagtatgattaccttaatagcatggtcatataaaacatatgaatagattacaaaacagtttagtgaattccatggaaattaaataaaagggccatggatagatttgaagtgatatattggagaataatcatgcccctcttaagaggcagtgaggtattctggaaagaacacaggcttcaagttcagaaacaaactgagtttgaaacctgggtttctcccttctcaagtccatggccttggccagcttgtttaactgctttgagactcattttcctcatatttaaaagaggatgatgagattataaaatctaactcaaaggaggagttaagcaggagtccagacactccttttgctacaatcaaaaccatcactccttgagcaccccaacactcaccacaaccccaacactcactcaccacccaactggcctaagctatgtagacaaatctccttaagctctttatgcccattcaccatcactctcaatgggaagcctagaactcccaggtaatccacatgcctggattctaactccaatatggttgtcacctttttgtaacgtggcttaatatttttagtaatttccaggtttctttattaaattcttctttataaaatataaccacccactaaaatataagttccataagtatgagtggcatggtactttttgctcactgctctatccccaggccttatgaatgtgtctcacacttatatttggttcatttcctcatactctttctgctacaacactacgtaagacctctgctaagaagactggatgaggtggtgcatgagtcacatgcctcaccaaaaagtaaaacaaaatatctgaagttaaaaaattatactgatctagaaacatactcctgcattattgtagatataaatcaagttatgcacagaattcaaaacttttgagtttgatctttctttaaataagtctccttagcttactattctgccctccattttgttggggtttaatgtttggtgaactgattatgtttatttagttagatatattagaagagtgaaaagagcattcctcagctaatgtctggttcttctgcttaacaatactatgaacttgtcatgctcaacttatacaaatacaaaactagtatagtataaaatttggtgttattgatgtcaagatttcatattagataatgaaataggcagggattgtataatatgtatagcttattaaataagtacatgttattagattttaactgccttacattatcttctttgatgtctaaaactgcatgttgatattcaaagtaatgtaaacttattttttctgtaaactgcccataaaaggcttgtgcttctggtacccttgaggtccaccagtagccaccccatgtcatcatagtgaaaatatgaatgagattaaaagctctgaatggaaacaaaatagtattttacatactttcttactcaagtgagttgggttaaacaaataacaatggaagaatattatttttctcatttttacatggaacatttatcaagagttagggctataaaacacacctcagcaaatagaaaataatgagaatcatacaaggtaaaatttcagatcacaatgaactaaactagaaaccaacaatagaaagacagatagaaaatccctatatatttatcacactgaaaaaccatatgggacaaggaaaaagtctcagataatattaaaaaaatgaaagaaaattaaaatatgacaccaaatttgtatgaggcagaaaatgaagttcttagagaggaatttatactacatagtattagataaatatattagaatagaagaaagattgaaaaatcagtattctaagcttccatcttagcaaaatagactaaagaaagcaatttaagctcaaagcacaacgactaagaataccataaaaattatgatagaaatcaataaaaatgaaaacaggaaacaatgaaatgcaactgtagctcttggaaaatatattttttaagattctctaggaagactgaccaagaaaaaagaacgtaaacattatcaacatcaaaaatgaaagaggggtcatcactattgatcctggggaccctaaaagagaatgattcaagcaaactacagagaactcagtgtccataaatttaatttagatgcagtggagcaattcctggaaagtacaaactaataaaattcacataatgagaactatctaacctaaataactttatatccacaaggaaattggatcaatttgctgagaccagctcggtcagggaaaccctaacccagtggagctagaagaattaaagacacacacacagaaatatagaggtgtgatgtgggaaatcagaggtctcacagccttcagagctgagagccccaaacagagatttacccacatatttattaacagcaaacctgtcattagcattgtttctatagatattaaattaactaaaagtatctcttatgggaaacgaagagatgggctgaattaaaggaatacgttgggctagttaactgcagcagggacacacccttaagacacagatcgctcatgctattgtttgtggcttaagaatgcctttaggcggtttccaccctgggcgggccaggtgttccttgtcctcattcccataaacccacacacttccagcttgggcattagggccattatgaacatgttacagtgctgcagagatttcgtttatggccaattttggggccagtttatggccagattttggggggcttgctcccaacatcaattattctatgatcttgcaaaaaataaatcaccaggcccaaaagttgtcaccagtaaattctaccaaatatttaaggaataaatgatatcaattctccaccatcttttccagaaaatggaagcagaaggagcactttcaaatccattctatgaagtgagaatcagcctcatacaaaaatcagaaagcacattacatgaataaaaatgcatagaataatatatctcataaagatagagacaaaatcatgaccaaaatattagcaaatccaatccaatacattttcacattttgatgcaataaaagttattttaggcatgcaaggctggttcaacatttaaaattaaaatcaatcaaaacaattcaccacattgacagactagagaagaaaaaacataggatcacagacttggcatagaaaaacatacatttgacaatatccaacactcattcatgattaaagaaaaacttttagaaaagctgtaatgaaggataactttctcaatatgattaagaacatctgaaaaaaaaactgttcaattagcatcatacttaatggtgataggtggatgctttctcccaaaatcaagattaggggaaagatgttgctatggtttgaatatgtgtcaccttcaaaactccttgaaatttaatacccaatatggcagtactgagaggtgaagactttatgagttgactggctcatgagggctctgcctttatgaactgatttatccattcatggattaattggttgatgtataaatgatttataatcggagagaactggtagctttataaacagagaaagaagaacttggtcttccacatgagcatgttcagctccctcaccatgtgataccctgcaccacctcagggctttccagatctttatttcaattaccattctccaattacagaatccaagcctccttgaagaaatgaataattttagactgataggaactattcaagatgagccaggagcatattgtggtaacaggaaataagaaaaaatttacccacaataatgaggacaaagggacagaggggctaattggaagagatcccaatagccaaagatgaaacaatctgagcaacagaattaataaagtagtactggattataacccaaattataaaataaatatatccaagtgtccatactgatacaaaaaggattgtataaatcaataaataatgaaagagaataggtaaatttcctgttcaggatgatttcaaattatttatgtcatacgtggcctttaaggaagtggaacaatactccccgctccttacttgtgggctgtgcatggtgactaccttccaaagagtacagtatggaatgggagggaaagaaaaattaactttacaatggagatgtctgacaaaccctaactcaagttagatgattaaggtcaacatcaacagcaataagatatattcatagcatgcactctcaatatgatgtgatgagaatggtactttaagtctcgtttttcttcccaaaacaattactccgatctaatcttgagaaaagcatcagacaaatcccaattgagggacgttctacaagataccttaaccagtgctccttaaaactgtcaaattaatcaagaagaaggaaattccaagaaactttaatgattaaaagtagccaaagaagacattactactgaatgtcaggtggtattatgtatcagattctgaacagaaaaaggacattgggtaaagactggaaaaatctcaatgaaaaatgcactttattaagtactttaacagttggttcattagttttgaccaacataccatagcaatgaaagatgtttacattggaattatctgtatgatctttgcaataattatgtaaatataaagcccctgtaataaaaaggaagtaaaagtttaaccgtaaaaagggaaccatatatctacatcaatatcttcatctctcgctctctgtctctataactatttttaatttaaaaattattttgaatcatctggggatttttttcaacatactggtgattggatttcaactccactcaattatatgagaaaatatagtgtaggtttttggcattggcatcaaatttttttaaagctttccaggagatagtaatgtgtactcagtattatgaacaattgaattagatgaactgaatgattactcctaaagaaatagaaaacctgagtattttaataaccacaaaatacagggaatcaaacacaagtggctttatttgtgaagcctaacaaatattcaaataacaggtaatgcctagattgtttaaacttctctaaaacagcgaatactttttgaaaaagttttattattctttctaagaagtgagcataacctgatatccaaagtcatctaggggatcacaaaaatgactccaataacaacaacattatagaccaatctcactcatggacagagatgacacactatgttaaagaaatattacatcaagaaaaaatagtttttatctcagaaatgatcttatggtttaacacaaggatattcagtgatgtgattcactgtactaatagtttaacccacataagtccagggaggaacatattccagtctttgtataaaaccttagtcatattaccaaattaactgtaaggtatttaaaacctcctctgaattcacaaaacatatgtcgacttcacaaatcccatctttgtgcataataacacttcaaaaaattctttttaaatgtttcttctacatattcatcaaatctccagaaactgactcaaagacttttcctcctacaaatttatccccaaacctggcctatacatatacagttcactacttaacacaggtttgagctaggcaagcccatttataggtggattttcttctgcctctgccacccaagatagtaaaagtaaccccttctcttccttctcctcttcatcctactcaacataaaaatgatgaggatgaagaccttgatgatgatccatttattatgatgatctatttattatgatgaatagtaaatatattttctcttccttattaatttttaaatattttatattctttagctaacttaattgtaagaatacagtatctaatatatacagcatacaaaatatgttttaatcaactatttgtattattgttaaggcttccagccaacagtaggctactattgtcaagattctgcagagtcaaaaattatatgcagatttttgacagagcaggggttggtacccctaatctccacattgttcaagatcaactgtatactttcatttcttatcccatctaacttcaatactctctttctttttccccttcattcaaacattaattctctgcactttctaaagcaggccctgttagattcatagcttttcctaatctgcttttttcttagaataacccatacaaaaggctaaggggccaatgagacaacacagaatcattttaacaagaaagaatagtggaagaaatggaaagcttcaaaatggaacttcaaaattttccttaattggtgagcaggaagttaaagaagttaattaatttgagttaatatgtttcactcagccataatagattaatgggttataacctcatggttattttgataaagttaaaaaaattcacttaccaaaattcaaatatttcctaataaatatatcttagctgtaaatgaggaacatttcttaaagtcagcatattattaaggaatcatttcaaaagttagcagaaaggatgaaatccttcattaattattttggaaaaattgtctctttggggtaaaaaagggggataatatagaatatttcatattatactcacaaatatactttggttgggttaatactaaaaaatgtatttagaatatgtataataataaaatataataaattataataacagagtagtcatgataaaatgtagtaaaactaaataaaatagataaaaatgtgaaaagcaattccagtcaggtgcggtggctcattccagaaattccagaaatttgggaagtcaagggaggaggattgtttgagcccaggagttagagaccagcctgggcaaatggtgacatcccgtctctacaaaaaattaaaaaataggaaagcagggcatggggacacatgcctgtggtcccagctactagggaggctgaggtgggagaatcacttgagcctgcagagcaaggttgcagtgagccataatcatgccagtgcacttcagcctaggtgacagagagataccctgtcatttaaaaaaaaaaaaaaaaaagaaagaaaagcatttccattatttcccagtgtgtaaaacccgcttacagaacataaaatctttaatgccctaagaaaaaataggcagatttaaatcaacaataatgaggatcaaaataatgacagatattgtaaatgcaattaagaaacaagcaacaaattaggagaaaatagttgcatcatataaaatatatatctggaacattcctataaattagatttacgaaggcaaacaacagagtagaaaaatgtgcaaagaataggaacaaaaaaataaatccaagcaattagtaactctaagaagaaatttctcagcctcccagaaataacaaaaatgcaaacagaaatacaaataattagggtatgtccttttgtttattaacaagataatatggtttggctctatgtccccccaacaaatttcatctcaaattgtaatcaccatgtgttaagggcggtgggacgtggatcatggtaatgggtgcccccatgttgttctcatggtggtgagggagttctcaggagttctgatggtttaagtttcccctgtgctttctctctcctgctgcctgtgaagaagttgcttgtctctccttcaccttctgctgtgattgtaagtttcctgaggccttcccagctatgtggaactgtgagataattaagtctctattctttataaattacacggtctcaggtatttacagtagtgtgaaaatggactaatacacaagacaaaactaaaactgaattggcaaagcaaacaggcagccttatcaaagaagcaatttggtgttatttgcctaagtctaaaaataagatcaaatagtctttgacccagtaaatcaatttctaggcattttttgtacatgtgtagaaacatatatatatattttatatatataattttaataaaaattggagataaatatggtttggctgtgtccccattcaaatctcaacttgaattgtacctcccagaattcccacatttatgggagggacccagggggaggtaattgaatcatgggggctggtctttcccatgctattcttatgatagggaataagtctcacaagatctgatgggttcatcaggggtttctgcttttgctttttcctcattatctcttgctgccatcatgtaagaagtaccttttgccttctgccatgattctgaggcctccccagccatatagaactctaagtccaattaaacctctttttttcccagtttcaggtatgtctttatcatcagtgtgaaaatgaactaatatagaaacaatacaaatttctgtaaatttttagcaaggtaaattgccatctaactacaggctacattttgcagccttccttaggcctgaaggtgatcctataccaattctgggcaatcatatgtgaatagcaatgatttttgcaatttctgggcagtaggaatatcaaacagaagctgttagtttttcatttcttctattatttctgccccattatatgggccgtatcaaaacatggtggagaggaatcagctcctcttgtggagatgacaaaaacgaaacaaaacatgttagtggatggatggaatctaggtcaccaaattatactttccatttgacttaagcccctattatttggttccagataaagaggttgaaataatatctcaaccaatgtagtagtaaatgcacacacattgagcctgtgactctgaaatatgaaaacactgttatagacacttttatcagaattcacatacaggtttacattcaaaaccaaaaaactgacatgctgacatctccaaaattcttaaagatacaaatctcaagcagtttagatttcatcttagttgcatcttttttactaacctccaaagtaagagccatctgtcagcttcatttctttactggattttgtaatgacaccagcaacaccgtgttgaatgaaatacatttttttacccacggctccttctcgtatgatataatctccaggttgaaacacctcaaatctcaacttgctcagcatggcagtcacaaaattaggatccgcattagcaaataaaggcattgtagccaccagtttccgacagttgaagttgactatctcctaaagatgtcaagagtaaacaaatattaagagagatattaatcatatctggaagaaaaacatgctgaaatttaaaatatatacagcataacattgtaatttaaatttagatacaaaaattcataaattctagtaatgcgcatcatattacagtcaggattatgttttatttttatgttgaaatttttgtattcccagcacctagtgtagtataggaatgtattaaatattcgataaatgttaattcaatatatgaaagtctcaacttttttaacttcccatttctttactactgtgtatatgaaactaaaacttctaaaatgtgaatacattctattcttccttttatcttttatttacgaagaaagaaagccatatcacttcctattagctatgccattcctgcttctgtgctcctttttgtctgggcccagctaccagacaaaaacattttgatgttttttttttttgttagtgtcattcacattagagtgaggacaatggatagtacagaaaaaggttacacaaaggaaactctaatctaaaagtataaattcatcaggtgcagtggctcatggctgtaattccagcactttgggaggccaaggcgggtggatcacgaggtcaggagttcaagaccagcctggtcaagatagtgaaaccctgtctctactaaaaatacaaaaattagctgggtgtgctggtgggtgcctgtaatcccagctactcgggaggctgaggcagagaattgcttgaacccaggaggcggagattgcagtgagccaagatcataccactgcactccatcttggacaacacagtgagactctgtctcaaaaagattaaaaaaataaaattataaattcaactggtgtctgggctagaatcagaaatcattctttctaaagactcctgggattcccctgcaagtgatgggctagagagaggacatatttgccttttcctgacttgtttgttttattccaggatcaggccaattctcaaataggagatctgtatgtttgatttcattctgtggattctgatcaaggttagacatatttttatccctctggatgaaaatagaaatatggaaccaaacatttttaatcatgcaaatcacttatgtgacacagaagagacagtggaaatttacatttttgccacaaagccaattctcagaaatttccttaccaattagttaccccaaaaaaggttgggactgcatttgtgattttgtgtaagagtcacagaaattggtcatgtctgctaagaggtgaaaagaaggcagaaggaatcataggtattaacagagtctgagaactctatcttctgccttggggaaatgtgctataccgacccatcaattccaagactgagaaagaaggtttctatgatcttacttcataaaataacctaatgccatccaggatagataaagaattccaggtgataacagaaggcacaacattttgaatctatcttggaagagaaggtgtttcatcctgaacaatattttatgagtttagcaaagcacaacaatgtctgtaatagtggagcttcatggaagatgagaaaatatttacaaataagcaacaataatcagaaagtgaacctagcagcaaagacaagagaaagatattacatgtggtacttggtgcatcattattcaaatcaaaatacacacttgagtccacgattggctgtatctagggaaatttgtgataattttagctgatgcatggagtgtgggtctataacaatgttcagcaagtagtaagtactgaatcaatatgcatgcatataaaggaagccattcgaaggaagaaatgaaggaggggaggaaggaaagaaagaagggaggaagggagggagcaggtgggaaggaaagaaggaagggataaaagaagaaacagaagaagggagggaggaagaaaggaaggaaggaaggaaggagggaaagaaggaatgaaggaagcaaggaaagaaggaaaggagggagggaggaaggaaggaagggaaggagggagggaggaaggaaggaaggaaggtggagtctcagttgtaaaaaagtactcataaagactaattttctcgttgggagatggttacttaaaactcttagctttctcaagcaaatggcttgagagacaagtcttctgtattaaaaaatttgtttttactatttcaaatatttctatacaaaaacaacaggaagataaaaggtgacgtggagttaaaagaagacagagttatgtcatgaaaatagctagatgagttgattgagagttaattatttcacatgtaaaatgacagaataatactgtgtaggaaattgaaaataagtcagattgtagagaaaataagagttttcatataaaaataatagagaatcccttcatctttgtaccttgatttgaactatgcaaatgtttcacttcatggatctctcattttttattttagaaaatagttggaattatatttgataagcaattaacctgatctttagtcatatgaataacttgttaatgatacattgcatatccaggtgtttctgttagaactccctttattataacactactggaataatttcatattattgtttgaagaaatctattaatgttttcttccttcatgcaacttttacttcccaggagtattacctgattaaaactgtaaattctaacagatatgatagaaaaaatggtaatgagacagaatcttcttggattctaaaaacctttcattctcccatgaaaactgcttgttctgaggatgtctagtatagtagaaacaatcatgtaagtatagaatgaagcaaaactttaaaaaaatatttttaatcaatcacctttccttagggcacattgaggcaaataaaacacactgttactatctctaatgtcaattcaaattacttatggcacttgttataattagctctttttatcaaaatatcaggattgagttaggagtattatctatgtgcattaaattgaggaaaggttgcttgctaaggaaggcaaacacatggtcctgaccttagtaataagttgctccagattattaagtttatgttggcactttaaaaaatgcaattatttctttcctggaacattttgtagtacaagaaagtatgtacatggtaaaaacaaatgaaaaaacaaacagaaagaccaatccccaaaatgaaacagaacaagaaccccacagtaatgaaggtatttcaaagggacacaggggccaactgaaagagttaccaacggtcaaacaaagctggaaaaacttgagtaacaacaataaaaagtattggattaaacccaaagtataaaataaataaccaagatcacatacaaatctaaatgattggttaaactactaaaaagtgagggataatacataagctttctgtttaaattccaaataatttcaaataattcatataagcactcctgcctcaaaaagttggagaataattaccaaacccttaaggatgggctgagcattgagcatggggacttccttcaaagaatacaataaggaaaagaggggaaaagtagtaactttccaatagagaaacatgaaaaactccacctcaagtcaggcaatcaatgttaacatcaacagtgctaaatcatgttggtagcatgtactcttggtttgatgtaatcagaagagcattttacttttgtggcattcctacaccaaacccataatcccattttaatcatgacaaaaccatcagcaaacccaaattcaggaaagttctgcaaaatatttggccagttctaaagatgatcaaggtaatcaaaaacaaggaaatttggaagaaactgtcccagacaaggggagactaaggagacatgacaagtgaccataatgtggtatcctggatgggatcctaggatagaaaaagaactttaaagaaaactaagggaatctgagtaatgttcggacttaataataatgtatcaatattgagtcataactgtagttattacaaatgtagcatactaatgtaaggtattaaaaacgggggaaattggatgtgatgtacatgggaattctccatactatttctgaaacttttttgctgatatagtttggatgcttggcacttcatgtctcatgctggaatttgacccaatgttggaggtggtgcatgggaggaggtgtttcagtcatgggggagaagaacccacatgaatgatttggtgctgtccttgagttaatgagtgagttctcactctattagttttcatgagatctgattgctaaaaggtgtctggcacctactttctctctcatgtcctctctcatcatgtgacatgcaggctccccttccccttccaccatgattgaatatttcctgaggtcctcactagaaacagatgctggtgccatgcatcttgtacaggctgctgaatcgtgagacaaataaatttctttataaataactcagtctcaggtattcctttatagcaatgaaaaatgaattaagaaatctgcaaatataaaattattctgaaaaagcttattaaagatgtaattactgctcttcatagttaagaaaataaatatgattttgtcatagcatgtaaagcatattttctttaagttaactcttttaaaagttacttttaaaaagatctcctagtaaatgcttgaaaacaattatatcatagtacagtctggggttaagcagcaggcctggaatgtgtctgtttatattgttgtggagttaataactgtggtctgtcataagaagacaaattgtatatatatcatgcattttcaatttcagatatatgtttctatcaagtttttatttacaaataaaaatctataattatttctgtattctgttccattgttctatgagtctgttcttgtaccagtaccatgctgttttggttactgtagccctgcagtagagtttgaagttgtgtagcatgatgcctccagctttgttcttttttcttaggattgtcttggctatttgggctagtttttggttccatatgaattttaaaacagttttttctagttctgtgaagaatgtcagcggtagtttaatgggaatagcattgaatctataaattgctttgggcagtatggccattttaacaatattgattcttcttatccatgagtatggaatgtttttccatttgtttgtatcatctctgatttctttgagtagtggtttgtactatccttttagagatccttcacttttcttgtcagctgtattcctagttatttgattccttttgtggcaattgtgaatggaatgtcttctgagatttatccctcagcttgactgttgttggtgtacaggaatgctgacacaatttttgtacattgattttgtatcctgagactttactgaagttgcttatcagctgaggaagctttaggctgtcataatggggttttctagacatgggatcctgtcattcgcaaacagggatagcttgacttcctcttttcttatttggatgccctttatttacttctctttcctaattgctatggccagaacttccaatactatgttgaataagagtggtgagagaagataccctagtctggtgctggttttaaaagggaatacttcagcttttgcctattcagtatgatgttagccgtgggtttgtcatatatggctcttattattttgaggtatgttccttcaatacctaatttattaacagttttgaacatgaagtgatgttgaattttatcaaaagcctttcctgcatctattgagataatcatgaggttttgtctttagttctgtttatgtgatgaatcacatttattgatttgtgtatgttgaaccgaccttacatccaggggatgaagcctacttgagttttggtggataagctttttgatgtgctgctggattctgtttgccagcattttgttgaggatatttgcatcaatgttcatcaaggatattgggctgaagttttctttttttgttgtttctttgccaggtttggtatcaggatgatgcttccctcatagaataagttagggaggactccctccttttcgactttttggaaaattttcagtaggaatgctactggctcttctttgtatatctggtagaattcagctgtgaatccatctggtcttgggctttttttggttggtaggctatttattactgcctcaagactaaatgtaaaacctaaaactataaaaaccctggaagataaccaataccattcaggacataaacacgagcaaagattttataatgaagaccccaaaagcaactgcaacaaatcagaaattgacaaacgggaactaattaaactaaagagcttctacacaccaaaataaactatcaacagagtaaacagacaacctgtggaatggcagaaaattttgtaaactgtgtatctgacaaatgcctaatatccagcatctatagtaacttaaacaaatttacaaaaaaaaatacaaacaaccccattaaaaagtgggcaaaggacatgaacagacacttctcaaaagaagacatacatgtggccaacaagcatatgataaagagatcaacatcactgatcattaaagacatgtaaatcaaaaccacaatgatataccatctcacatcagtcacaatggttattattaaaaagtcaaaaaataacagatgctggtgatgttgtggataaaaaggaacgtttatacacccttgatgggagcataaattagttcagacattgtggaagacagtgtagtgattccttaaagacctagagacagaaataccattcaacccagcaatcccattaccaggtataaacccaaaggaatataaattgttctattataaagacatgcatgcatatgttcattgcagcacaattcaaaagagtaaagacatggaatcaacccaaatgctcatcaatgaatgactggataaagaacatgtggtaaatatatagcatggaatactatgcagccataaaaaagaatgagatcatgtcttttgcagggacatggatggaactggaggctatcatccctagcaaattaattcaggaatagaaaaccaaaagcctcatgttctcacttacaagtggttgctaactgatgagaacacatggacatacagagaggaacaacacatactggggcctatcggagggtggaaggagggatagaaccaagaaaagtagctaatggatactaggtttaatgcctgagtgatgaaataatctgtacaacaaacccccattatctccatgttcatctatttaacaaacgtgcacatcctgcacatgcacccttgaacttaaaatgaaagttaaaaaatctataattatttcaaagttagaaatatatattcatttattaaacacaccaaaagtgagggagaaacaaaaatgttgttccaaagaaattctctctccaaggaatattattacataatttatatagcatcaatatggtttttattttaaaagatctcaagttgcccactagcaaaagggtggatttcaaatgttactatttaaaatacactggttcaatttcttcttacttttgcaatcagcttatattagaaaatttgtttaaacatcttagaagggaattgataatttttgctaatattttattttgttaaaataagtcataagaaatatttggcataaacacccatgcagaaatgacataatttttaagttaaatgatattaagttctctggagtggacttgttgctttagtgttgataattatggcataagtgttatgatccatggaggatatgttgcccataaaaggaacagttcgatataaaagtgttgactgaagaaatgccaagaatgtgatttcagtaatattctttgcataaggtttctcattgaaaatgcatgagacctgcagctttatttattcctctgaggaaaacttcagacagagcagtaattgcagaggaagagtacactggtcgccttggaacctggagggaattttcaccctcaaagttcatcaacagctttctcaaatttctagctgtgggctaaacactgggaagccaagtaaataagctcagatgctatgggaaatgctgcaaactatttcctcaaatatttcaagtaagaaaaaatctttgttgtcaagaagagtccacgttggaacccaaggtgtacatatatttgtattcattaagaaggtgtcttaaaagatgacatgagatagaaatgtttatgtcagatgtttctgggatccacctttcaaccaaatggaatggttgtttcagtcttctaaaacattcaagcacacacttgggtgaagatttttcttatgcaatgccctcttgaggatgcttctcatttggcaaacggtaaccctgctaaagggtagtgctaagattttaaattgaattttatatattatatacaagaatgaaacagcataatacaagaatgaaacagcaataaagaatcttgttatttgttctttggttgacacgatgtctatttattttagatataaaagtatttgctgggggcggttccaagatggccaaagaggaacggctccagtctacagctcccagtgtgagcgacgcagaagacggatgatttctgcatttccaactgaggtaccgggttcatctcactagcacttgtcagacagtgggtgcaggacagtgggtgcagcccactgagcatgaactgaagcagggcgaggcatagcctcacccggcaagtgcaaggagtcagggaattccctttcctagccaagggaagctgtgacagacagcacctggaaaatcgggtcactcccaccctaatactgcacttttccaatggtcttagcaaacggcacaccaggagattatatcccgcacctggctcagggggtcccacgcccacagagccttgctcattgctagcacagcagtctgagatagaatcgcaaggtggcagtgaggctgggggaggggcgcccaccattgctgaggcttgagtaggtaaacaaagcagcctggaggctcgacctgcatggagcccctcgcagctcaaggaggcctgcctgcctctgtagactccacctctgggggcagggcatagctgaacaaaaggcagcagaaacctctgcagacttaaatgtccctgtctgacagctttgaagacagtagtggttctcccagcatggagtttgagatctgagaacagacagactgcctcctcaagtgggtccttgacccccaagtagcccaattgggaggcaccccccagtaggggcagactgacacctcacacggcagagtacccctctgagatgaagcttccagaggaatgatcaggcagcaacatttgctgttcaccaatattcgatgttctgcagccttcattgctgatacccaggcaaacagggtctggagtgaacctccagcaaactccaacagacatgcagctgagggtcctgactgttagaaggaaaactaacaaacagaaaggacattcacaccaaaaccccatctgtacgtcaccatcatcaaagaccaaaggtagataaaaccacaaaggtggggaaaaaaacagagcagaaaagctaaaaattctaaaaatcagagcacctctcctcctccaaaggaatgcagctcctcgccagcaccagaacaaagctggatggagaatgacttcgatgagttgagagaagaaggcttcagacgataaaacttctccaagctaaaggaggaagtgcaaatccaccgcaaagaagctaaaaaccttgaagaaatattagacgaatggctaactagaacaaccagtgtagagaagtccttaaatgacctgatggagctgaaaaccatggcacgagaactaagggacgaatgcacaagcttcagtagccaattcgatcaactggaagaaagggtatctgtgactgaagatcaaattaatgaaatgaagtgagaagagaagtttagagaaagaaaagtaaaaagaaatgaacaaagcctccaagaaatatgggactatgtgaaaagaccaaatctacatctgattggtgtacctgaaagtgacggagagaatacaaccaagttggaaaacactctgcaggatattatccaggagaacttccccaacctagcaaggcaggccaacattcaaattcaggaaatacagagaatgccacaaagatacgagaagagcaactccaagacaaataattgtcagattcaccaaagttgaaatgaaggaaaaaaatggtaagggcagccagagagaaaggtcgggttacccacaaagagaagcccaccagactaacagcgaatctctcggcagaaactctacaagccagaagacagtgaaggcccatattcaacattcttaaagaaagaattttcaacccagaatttcatatccagccaaactaagcttcataagtgaaggagaaataaaatactttacagacaagcaaatgctgagagattatgtcaccaccaggcctgccctacaagagatcctgaaagaagcactaaacatggaaaggaacgaccggtaccagccattgcaaaaacatgccacattgtaaagaccgtcaaggctaggaagaaactgcatcaactaatgagcaaaataaccagctaacatcataatgacaggacgaaattcacatataacaatattaaccttaaatgtaaatgggctaaatgctccaattaaaagacacagactggcaaattggataaaaagtcaagacccatcagtgtgctatattcaggacccattaatgtgctgtgttccattcaagacccatcagtgtgctgtattcaggagacccatctcacatgcagagacacacaggctcaaaataaagggatagaggaagatctaccaagcaaatagaaaacaaaaaaaggcaggagttgcaatcctagtctctgataaaacagactttaaaccaacaaagatcaaaagagacaaagaaggccattacataatggtaaagggatcaattcaacaagaagagctaactatcctaaatatatatgcacccaatacaggagcatccagattcataaagcaagtccttagagacctacaaagagacctagactcccaaacaataataatgggagactttaacatcccactgtcaacattagacagatcaacgagacagaaagttaaccatgatatccaggaattgaactcagctctgcaccaagcggacctaatagacatctacagaactctccaacccaaatcaacagaatatacattcttctcagcaccacatcacacttattccaaaattgacaacatagttggaagtaaagctctcctcagcaaatgtaaaagaacagaaattataacaaactgtctctcggaccacagtgcaatcaaactagaactcaggattaagaaactcattcaaaaccgctcaactacatggaaatggaacaacctgctcctgaatgactactgggtacacagcgaaatgaaggcagaaataaagatgtcctttaaaaccaatgagaacaaagacacaacatgccaaaacctctgggacacatttaaagcagtgtgtagagggaaatttatagcactaaatgcccacaagagaaagcaggaaagttctaaaattgacaccctaacatcacaattaaaagaactagaaaagcaagagcaaacacattcaaaagctagcagaaggcaagaaataactaagatcagagcagaactgaaggagatagagacacaaaaaacccttcagaaaaaccatgaatccaggagctggtttttgaaaagatcaagaaaattgatagagcactagcaagactgataaagaagaaaagagagaagaatgaaatagacacaataaaaaatggtaaaggggatatcaccaccgatcccacagaaatacagactaccatcagagaatactataaacacctctatgcaaataaactagaaaatgtagaagaaatggataaattcctggacacatacaccctcccaagaataaaccaggaggaagctgaatccctgaatagaccaataacaggctctgaagttgaggcaataattaatagcttaccaaccaaaaaaagtacaggaccagatggattccacaactgaattctaccagaggtagaaggaggagctggtaccattccttctgaaactattccaatcaatagataaagagggaatcctacctaactcattttatgaggccagcatcatcctgataccaaagtctggcagagacacaacaaaaagagaattttagaccaatatccctgatgaacatcgatgcaaaaatcttcaataaaatactggcaaaccgaatgcagcagcacatctaaaaggttatccaccatgatcaagtgggcttcatccctgggatgcaaggctggttcaacatatgcaaatcaataaatgtaatccagaatataaacagaaccaaaggcaaaaatcacatgattatctcaatagatgcagaaaaggcctttgacaaaattcaacaccccttcatgctaaaaactctcaataaattaagtactgatgggacgtatttcaaaataataagagctacttaagacaaacccacagtcaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattacaaaaagaggaagtcaaattgtccctgttggtagatgacatgactgtatatttagaaaaacccatcgtctcagcccaaaatcttcttaagctgataagcaacttcagcaaagtctcaggatgcaaaatcaatgtgcaaaaatcacaagcattcttatacaccaataacagacaaacagagagccaaatcatgagtgaactcccattcacaattgcttcaaagagaataaaatacctaggaatccaatttacaagggctgtgaaggacctcttcaaggagaattaaaaaccactgctcaacgaaataaaagaggatacaaacaaatggaagaacattccatgctcatggataggaagaatcaatattgtgtaaatggccatactgcccaaggtaacttattgattcaatgccatccccatcaagctaccaatgactttcttcaaaaaattgggaaaaaaactactttaaagttcatatggggccaaaaaagagcctgcattgccaagtcaagcctaagccgaaagaacaaagctggaggcatcacgttacctgacttcaaactacactacaaagctacagtaaccaaaacagcatgatactggcaccaaaacagagatatagaccaatggaacagaacagagccctcagaaataataccacacatctacaaccatctgatctttgacaaacttgacaaaaacaagaattggggaaaggattccctatttaataaacggtgctaggaaaactggctagtcatatgtagaaagctgaaactggatcccttccttacaccttatacaaaaattataagatagactaaagacttaaatgttagacctaaaaccataaaaaccctagaagaagacctaggcaataccattcaggatataggaatgggcaaggacttcatgactaaaacaccaaaagcaatggcaacaaaagccacaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaaagagctcaaacaaatttacaagaaaaaaacaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccacttagaatggcgatcattaaaaagtcaggaaacaacaggtgctggagagtatgtggagaaataggaacacttttacactgttggtgggactgtaaactagttcaaccattgtggaagacagtgtggtgattcctcaagcatctagaattagaaataacatttgagccagccatcccattattgggtatatactcaaaggattataaatcatgcagctataaaaacacacgcacacttatgtttattgtgtcactattcacaatagcaaagacttggaaacaacccaaacgtccatcaatgatagactggattaagaaaatgtggcacatatacaccatggaatactatgcagccataaaaaagatgaattcatgtcctttgtagggacatggatgaagctggaaaccatctttcttagaaaactatcgcaaggacaaaaaaacaaacaccacatgttctcactcataggtgggaattgaacaatgagaatacttggtcacagaaaggggaacatcacacaccagggcctgtcgtggggtgggggagggaggaaggatagcattggaagatatacctaatgtaaatgatgagttaatgggtgcagcacaccaacatggcacatgtatacatatgtaacaaacctgcacgttgtgcacatgtaccctagaacttgtataataaaaagaaaaaatattatttaataaaataaaaagaaaagtataataaaaaaagaaaaaaaaagtatttgcttacagcagtccttcccattattttgctaaaatatgacaggattattcatgttcattatttagtcacagtgtagggagtttcttttaaagttacaacataacttgaagtggacaaatcctaagtgtacacaaattttaagtcattttttaaaaaatatatatgcacccgtataaccagccggattcaaatatagacaatttctcagaaggctccttttgcctcatcttagtcaacccagaggttctagctattctgatttctatcactacagagcaggtcttcttgttcttgaaagtcacataaatgaggttgcatactgtgtagtcttttgtgtcttggttcttttactcaccattctgttaatgtgattgctaagtgttgtaagtgggagttgattctttttaaatttcaggctatatttcattttatggttatactacaatttatttatccattctactcttcatgacatttgggttgttaccagttttaggctaataaaataaatgtcagctaaaaattaaaagctgggaggaacattcttgaagcatcttatgcactgatttggcttgagtgtacaccatatattggaatttctgggtaatagaataagcacatacttcactacagttgctgccaaaagttttcctggatgcttctattattattctctcattccatcaacaggtgatgtttcagttgtcccacatctttggcaaaatttgattttatcatttagccattggtgggtaagtcgacatatctgactgttttgctttttgcacttgtgttttttcttattgtagttttaatatgcattttcccatgagtatcctcattatgcacattttcctaagctttttgatcagatgaatagcctgttttgtgaggtgcccagtaaagagtttccccctttttctatgttaagagttcttcttatactcttgacatgagttctttttttggggatatgcactgcaaataccttctcgccatctgtggcttgccttttcactctaagtagtatcttttattgtaattgttttgttggtaatttgtttcctggttttttttttagctttagaacttccagaaaaaaaatgagtttgatatattcagattgcttctagaaggatttatgttaatcacaaatctgtattttggaattctaaatactctgaaactttaagaaattttaagcaatatctcatttagttattataaaaaagaatagcaaaactttaaggttcctttagcactgtaactttatattgataacttaaatatcactgtataaagtccaatttcgtgaaacctctaattcagctccattttacattatgattattctaaacagtatatttctgaaaagttttaagcatggtagctatacatataatttccaccattacacaaatgaatcatagagtaatcttaacaaaatagagctgctgttacattgctaaatttctacactccaacacaccctatatttttagactatacagagcatataagatcttccttctaagaacttagacattcaaaagacatccctacctggagatttctatattgactttagaaacaaataaatatatggaagcaaatctataccacatgacacctcatctcctagagaacatcctattaaaaagtgctccaaatatcccattttttctttccaattcagtagcttgggttctttataatcaaaacagcagttggtatgtttagggagtttttttgaggtaaagataattctaagaatgaatgtaataaaaagaagagtcaacatctattgagttcttgctgggttttaggtattgtctaaatgttttacaaatattaatttattttaccctcacaataatcctatgtcttaggtagtattactgccccattttgtagatgttatatagtctgccagtaaccacatgcttgcaagaggaggaactatggtatcccagggcagcctggcttgctactttgggattttgatggattctgagaagccaccttaacctttgcacaaatctagaatcaccacaaatcttgaaggtttagatattaaccaacaatttgtttttttgagttatatatgtttgcaaagacagacatggacatttgttgattgtcaggtggcaactgaaggctatacattggcttttaaaaatccgaatggtttttaaaaatctgaatctgaatccctttatacatagcatgtacatttctattcgtcacagtttttaaaacaccgtctgtatttaacatctctactttctacaattaggctgactggcttcttaaagcaatagaatttgagatctttggacactaaaccaaggaactgcaagaaaagaaagggagaccggtatttgttcttgtctactgggggattcatgtcttacatcacaggggacagtgtcaacaaaatgaaaattttctttgtggcttgtcaatgactgccctttataccttcctttcaaagaaatgtttctatttgtttcctcaacggtatctctggatctccctacacagcccccaaaataacatttgtaatttattttgattacaaattagggatgtagaaagaggatgggaacctgatttattaagcccccattttgagctaggtagttcgcatattatatctcacttatttattcctgggggaaaaacaacgtaacaataaacttaaattttgttttatttcttcaacatatgcagaagaagaaagtggtgcttagagagaggaaaagtattgccaaggctacagagctagaatatgtgtagagaaaactaactgtgctcatttcaccccacagtggggcctccctgttatctggataaaagtcatgaaagcttagcacgtagaattaaaccacagctttatattttgcaatagtgtatatttcaaaatgaaaaaaaagagtcacttttagcattttacagcttctttaatctaaaattttgcccattggagactaatacctattttttttgcttaaatgtatttcttagacaatttacattttaaaccagcttgaatgccatattttacacacatacgtatttttatggcagatcatttaatagcaatacgtttactgttgtgggattatttaaacatacatggttctagttaaggtatattttaaaaatcttgcattttattgcatatgattcaatttttgctgtgcaaagataactgctttaatgatggtcaaatattttttgaaaactaagaaaagcaatgtttattttgcatacaaaaataactttatcttcaattatatacattcatttatatgtcaggtaaataagaagcatttcctctgtgcctcaccagaaaattagtgtaaaaggtaaatatggaagaaaacaaatgagatcttgaggcataactaaatgattcagcattatattggtaaataagcatcctggttaatatgaacttatttcctctaataattccgtgacatagtcacaaatgttttaagagacaactggagtcttggtagctggagctatacaacaattaatttaaaaaatgtaaacatggagcctaaggacacttaataaaggtgttaatgggctttgggtggctgtcctaaacccattgaaattatatgcaaataggtgaatactgtgtttgtgtgttatgtgaaacagatggcagcttttcttagattttttaaagggtccactggtctaaatgtagtataatgaccacaatgatgatattcactaatatttattaaatgctttgtgctttctcatgtaattataacaacaacccaatgaaacacaggttgagaatgtcttatgtgaaatgcttgagaccagaaatgtggcagattcttgatttttctcattttagaatatttgcatatcccaaatgagaaatcttggggatgggattcaactctgaacatgagattcatttatgtttcatatatacttcaaacatacagcctgaaggtaattttacacaatattttaaaataatttgtagatgaaataaacttttgattgcaacctgtcccacgaagtcaagtgtggaatttttcacttgtggcatcctgtcagtgctcaaaaagtttcagatattagagtatttagaagtttggattttcagattaggaatgctcaacctgcagttacattattaacccaattttatagataaaccaaatgagtctcaaaatggttgtcatttgacaaaaatcacagcatgtaggaagtgaaacctactactactaagaggtatgcagtctgttccttgagcaaccttgtctgatataatagttcctaattgcatggggttttcaggcacttgaaacacggctagtgtgagggaggaactgagtttttaatttatttaacgttaacccatttaagcttaaagttaaaaactgatacagttccgtttttagaaaatggtaaattatgcttgaagacacttggacaggtggatatacttcttcaattgtaaactgtatgaaatctacatacaggttaagcatttctgagaaaaattcagcatccaaatcaagatgtgatgcaagtattaaaatatacaccagattgtgaagacttgataaaaaaatgaatataaactatctcacgaatgatgttcttatattgattgtgtgttgaaatcataacattttggatatatttagttaacaaatttattacacttaattttacttttttatttcttagtataactactagacaatttaaattatataattcctattacatcttcactggacagtaagcactgctgtagaacaatcatgatatcatatagaagggaatgaaaaataaaatggtagaatgcctttctagattttttaaaaacctttattaatttagaaagaattcaacaagacaaacatagagtaaaatttttcttttttttcattttttatcattattatactttaagttttacagtacatatgcacaacgtgcaggtttgttacttatgtatacatgtgccatgttgctgtgctgcacccattaactcgtcatttagcattaggtatatctcctaatgctatccctcccccatcccccaaccccacgacaggcccggtgtgtgatgttccccttcctgtgtctctgtgttctcattgttcagttcctacctatgagtgagaacatgtggtgtttggttttttgtccttgtgatagattgctgagaatggtttccagcttcatccatgtccctacaaaggacatgaactcatcatttttatagctgcatagtattccatggtgtatatgtgctacattttcttaatccagtctatcattgttggacatttgggttggttccaagtctttgctattgtgaatagtgccgcaataaacatacgtgtgcatgtgtctttatagctgcatgatttataatcctttgggtatatacccagtaatgggatggctgggtcaaatggtatttctagttctagatccctgaggaatcgccacaccaacttccatgatggttgggatctaattaaactaaagagcttctgcacagcaaaagaaaccacaatctgagtgaagaggcaacctacagaatgggagaaaatttttgcaatctactcatctgacaaagggctaatatccagaatctacaatgaactcaaacaaatttacaagaaaaaaacaaccccatcaaaaagtgggtgaaagatatgaagagacacttctcaaaagaagacatttatgcagccaaaaaacacatgaaaaaatgctcatcatcactggccatcagagaaatgcaaatcaaaaccacaatgagataccatctcacaccagttagaatgacgatcattaaaagtcaggaaacaacagctgctggagaggatgtggagaaataggaacacttttacactgttggtgggactgtaaactagttcaacctaaagtaagatttttcaatatttatttataacttgaagagacaggtgaaaaagaagatgaaattccacagactaataaaacatggcttggtttgacacttggaaaaataagatttgaatgctaagacttccaagaagaataaatcaatatctggaaatggctagctagccaaagttaattttgagaaatgtcactgaaaagctctgggaaagttatctgcaattataatctctacgctgactacacgaaatttgtgaaaaaaaattttttaaagttaaaataagaatcaaggaaaattaaaataaataaacaaaataaaacatcattatcttgtgatacagtgccccaagcttctactcctttggagcagtccttagtgcccaaggaaatgacagctcagaaatgaagtgtttaacacagaacttggtgcatagaaggtgcccaggtgggaagaagtttgtaggtacaatgtaggaccaatctggagcaggaacagaatgtactcaggattattacaaggccgttgcccccattatggctctgaggtagacaaggagaaaaaaattgcttcactgacctgccaaagatgacatttgcatctctgttattatttagaggaagacagcacctctgcggactcatttatggtattttttctaaattagccaggttccaattcagattcacataactctttagggaatataactcaaaatctctgtcattaataaaacactccaagtcataagcagtcaggtgtggaaaccaagtctcctagattaacaagtatctggaaacctacatctaattgagaaagaaagctacatatgtatatattcaatacatgatgattgtaaataataaaataaatgtgggttttgatcaaagtcaacaaataaaacatataactcataataaagctactctattgatatgataaatttggagggcaaattataaattacacatacattccattattaaaaaagaaaacacatgagggcaatttaaaaaatatattcttttccgtcagcatttccaatggacttatattaatctggtggtttgtcttctaaattgcaagatggttcactgcatatatgagaaaatcagcccatactagcagatcttaatgaattaaaaaatcttttgaacattcattcaagggttgactagtaagttcagcacctgcttcaatgtcttaattttaaaggatttcccatgatttctctgtctctagtaggaaggatttacacagatttatatttgcactataatctgtcttattttttaaagagatcttatggtgcaactcctgaataataagagtgtcaaaaatgatgtattaaattacaggggtaaaaaatacttatttttattatttatattttgggagttgaagttacatgtaaaaaaaaaggagggctgatgaattgacataagatgccttaatttaagttttatttaactcccctttcattaagattaatcaagcattttctaaattaccaaactgtatttttaaagtatttgaaaacaaaaggaccacgcattttccttaaaaaaattacatatacatttatatatcacattgcatgcctgtactaaaacatctcatgtaccccataaatacatacacctactacatacccacataaatttttaaaaaataaacaactgaaaatgtatatctttattgtcatcatcttcatgaaagaaatttatatatgtattcccttcaaataatctccagttcaccttaacgtagttgtaaccataatgtatattcaatatttgtttcctttttctacacttgtaccacaaaatatttcccaaattgtgacataacccacattgccattctttttagtggccacaaaatgtttcatcttatgttaattatagttatattaagaaaaataggcaggaagagaaatagactgcaatagcctcttaaataatggcaaactttagcatttttcactattacttgcttacaaaccaagttatttctttaactgctaaattaatagatttcaagttataagtcaaaggtaattagcctaaaataaaaaattattactaagtggcttaaattatatcttgtaaaagatcagagcaagatgaattttgagatgtacaaattaaaagattttaatgttttctgtagttacagttctggtatgcatttaatttggccctgaggtatttaatcacatagaaactttacaatacacatgcaaatgaagtttgaaattaattttgtcttagcatagtcccactgctttgccttactagaacatagggacatactgttctgttaaggtaccatgcagaatgacagcagataatgcaaaactctcttagtgttcacttccatttgattataaagggaaaaatatagaagcagacaaaaattaaaattaaaaatactaaaattaaggaattgtatattgacaggaagagtgttcattagagaatttgtatctctgctttactatgtggtatcaggtgctcaaagcagtcatttgatttttgtaaggtccagcacaatttagctccagtcgtccatctgtagcaaggtgtaagaatgatttgcccaataggagttaagtctatttgaggtgataaaaaagcgattgatttttaagtggcataaacaatgtccagaagtatgctgaaactaaacaaatgtccagaagtatgctgaactaaaaaatattattaagagaatatcaccgatagtagagtacatctgaagacttaattctgtgagaaaatgacttggagaatttggtaaaaacttttttcaaaattttattatagaatccacataaattaattttcattattaacaaatcagcaacagacacaattcaaacataacaatatatgtatatgcacatgaggacctaaggaaatcaagtcaggtcctaaaatcaggcaagagtactaagataaattaaacattcttttatctctcactttagttagatttttatgggacattacatgtgttagcatttgttatgggttgagttgtgtctcccaaaaaaatttatatgttgaagcaactgtacctgagaatgtatttagatagagggtatttgaagaggtaattaagttaaaattaattaactagggtgggccataatccaatctgactggctgactggcgtccttttataagaagaggaaatttggacacacagaaaagacatctggggtgaacaagcacagagaaaaggaagccctctgcaaatcaaggagagaagcctcagaagaaactagacctgccaatacctcgatctcagacttccagtctccagaactgtgaaaaaatacatttcttttgtttaagccacccagtttgtggtattttgtcatggcgtccctaaaaaactaatacagcaagttaggctggtcaaaatgtgacaagaagaatgaagttgccccttctgaagatctgccaagatgtatcagtacagtagtcccctgtcctctgtggggagtatgtcgatgcctgaaatctcagacagtgctgaacccatttgctgtcaatcagaacacatttctgttcatgtattccacacacaaattgaatgcctttttcatcttaactaagcacttatcatgattgtggctgtaactgtcgcagtttgcggtgccacagcaaaactagcatttttttttttcttcacaatttcatgaatagaagattagttcttacagaagatcttagcaatctcagcatataatttttttctctcatattacatagagaactttcaccttttcacttgaagcattttatggctctctggcatatacgaatgaccagcatcactactgatgtgctttggggaaacttaattacctcttcaaatatcctgtatctaaatacaagctgaggtagtggggcttcaacatttatttggagaagtcagataaggtggcttgaaaacaagcataatgatacagcaacagtttacctgataaccaagatgactatgaagtgactcaagcattgtggctccactgggcaaaagaggattcacgtcccaaaggagatttcatcccactatttagaatggtgcacaatttcaaacttatgagttgtgtatttctggatttttccatttaatattttcagaccagagttattctctagtaacgaactgaaactgtggaaagggaaaccacagataaaggcaggactactctaccactgctctgaaagtgaactgtggcagaagcactatacacaatttagttaataagcgatattagcatctactttgcatagatgtggaacacagtctacacacttcaagaccttctgagtttttcagtttgggaaacaattaatttaaacaatatttagtgttgtggaggaaggatattttgttttaaatgtattgtatgtgaagcatctttgacattgagataaaagtgggaggcagataggagtggttttggagattaggaaaatagattcaagattgggtgccattttctaagactattttcaaaaaactgtttaaatatatgtaacaatattaatagtttgaccattcataagtatacaatttgtcagtacattcactatgtaatatcctcactatctatacctaagcctttttcatcatccccaacaaaaactttgtaaccattaaagaactgccactttcctccccttccccagcccctggtaacctctgttctactttctgtgtctgtcaatttgcatatcctagggacctcttataaatggaattacacaatattagcatagagtcaatttttgaagtcttagagataaacaatgtcactcagagaaagagtggtggtgtagggagtgggggataatattaggaaaaatcaaggaaaaggcacaggagtctggatctctcttattacaataatacaatctgctccactcccctttctgtctccttgattcagtggaagtaagaaaacttttaatgaacatattgtacataagagatggtgcctgagaagtttatgaaacaaatgatcatagaataaattatttttgcaatgactcatatacatttatagatatggggaataggtattttggaatcttttttaaattaacactatttatgtcccactgtagaaccttagggaaaattatttaaattttcatatttccaccagaatctaaaattcagagatacctgtcatccagcaagaattgggattgaaataataacaaagaggtactgtgacttatggcttagaaggttcttatacacaaatcattttatttaaccttacaaccatgaaagactggtattattattttaattttacagaataagttggggcagtcaaggagattccagataggagagcaaagaccatcttctttccaattacatatatagattttcaattagagattttactttggaaaaattttaggtttacgaaaaaaatgcacaataatatagagtgtgtccatgtgccccttacacaattttctcaaaggtttaattcttatattactatgagacatttttcacactaagaaatcaacattgctgaattactattaaactccagactttgtatttgattagttttccacttgtgcttttgtatgttccaagatccaaaccatgatgccatgctgcatttggcatacataaatatttggggagttattaaatactggagtttacactgttgtgctttaagaaattgagcttggtcaaatacaaggaaggaaattgtggatatatcaacagtttgttggaacattaaaccttatttttgtatgacaaataaaacttaactaaataaacgcacaagacaccatcatatatatacatatgatgtacatatatacatatatatataatggcaagatgattttacatatatatgttttctgtagttacagaaaacatttcatgtatatgtgtatatatatgtaaaatcatcttgccattcctagaaaaaattaaaaatgcagcattagaaaaaaggaaactaagtttaaatgactcatcaataatttttaatagacaaacaataatgtatcatgtcacttgtttccttttctttttcagtgagatagctttgcaagaaattcttattactcaatacaatgttttatagattgtttcataagtatcaaatatgcttctttggtattgatgtttcttgtcctactaatgcatactcattcatttaaaaaaattttcaaatatatttttacctcaaataatgtatatattggaaattttatctttctcaaaagtatgggttgcttaatattgagataatttctaatgggtaaaatttaccaggaagccacttgcaaaaactttaaaaatgttattttatatgcctttgtatctgtcttactttaaccactttttgttttccttgaaatatataatttagatgatagaatttcagtttaagatatatgtcaaatatttctacttttcttcattagtttttgagatataattcttagccttctctagattttcctgcatattatctttggcattgaacaggtagacatggctcacatttacatcaggtaaagtgtagaattcaacttaggagatgacaacatttaaatatattaatatcagtattaagagttcttagggcagtaatcattgtaaaaataatattattgaacagttatttcacactgggttcttaagtgttttacttatcataaagcataatttaatacaccaacacagcttcctagggaacagacactaggctagtcacttctctataaaatacacttattttccctaatttacaattataaataaacattataggtatataaatcctgtgtataaccgtaacaggagaagtagttttaaaatatcaaatttaagtcatcaaatatttcagtggctttatctaatattgtttatttcattttagacttattaatattttacttcacgtaatcaacatgtatatattaaatcatcactctgaattcaactcaagagctcagatctttctaatatttgtagttttctgtcactcttgaacacaaaggttatattgtttatatgcctatgtatctcaacacacctgctcataatcgcactaagtaatttatttgatgattgcaatgacagcaaaaccaaactacccaaacacgtgatatgctgttctacataaagtcgatttttaaaaatcaatatcatcattatcatcatcaaaatcactaccaccaccatcagcactgtcaccaccatcatcatcagtaattcattgagttgacatacattatcttactctatattctgccaaggcaagcttcaaaatcaaatgatattagatatcttaataatttccataatttaacaatgtgaagctctagctatataagtcaactggggggatattttaaacaacagaaaattggtttatataagctagacaaatgtagtatacatatgttctttaatggttctgattttaaactctggaaaacagtattgtctttttaaaatttctatttagctcagtgtagagcctggatgctaaatagaagctttacctagcacaggcatctttctaatcttttcttaaaatttttttgtgggtacatagtagttgtatatatttatggggtacatgagatattttggtacagtaatgcagatacttttgtatgagtagtaatcacatcatggaaagttgggtatccatcctcaaggatttatccttcatgttacaaacaatccaattatactcttttagttatttttaaatgtacggtgaagttattgttcactatagtcaccttgctgtgctgttaaatactagatcttattcattctttctatttttttttttcgtacccattaaccatcctcaccttcccccaactaaacttctcagcctctggtaaccatccttctactctctatctccatgagttcaattgttttgattttcagatgccagaaataagtgaaaacatttttttctaactatcatttttgtacccagtaagcatccccacctccccattaccctcccactatctttcccagcctctggtaaccatttttctactccctaccttcaatgagttcaattgttttcatttttagattccacaaaaaagtgagaatatgtgaggtttgtctttttgtgtctggcttatttcacttagcagagtgacctcctgttccatccacgttgttgcaaataacaggatctcatttttttttatggctgaaaagtaattcattttgtataagtatcacattttccttttccattcatatgttgatggacacttcagttgtttccaaattttggctgttgtgaacagtgctgcaacaaacatggaagtgcagatatctctctgatatctcatttcctttcttttgggtatatacccagcagtgggattgctggatcatatggtagctcaatttttagctttttgaggaagctccaaactgttttccatagtggtcgtactaatttacattcccaccaacagtgtacaagggttcccttttctccacatccttgcaagcatttgttattgcctgtcttttggatataagtattttaacttgggtagatgatatctcactgtagttttgatttgcgtttctctgatgaccaatgatgatgaacatcttttcatatgcccgtttgccatttgtatgtcttcttctgagaaatgtctattcaaatcttttgagtattttttatttggattattagacttttttcctatagagttgtttgagctccatataaattctggttattaatcccttattagatgggtgtgttgcaaatattttctcctattctgtggattgtctttttactttgttgtttcttttaacgtccagaagctttttaacttgatgtgattccatttgtccatttttgctttcgttacctgtgcttgtagggtattgctcaagaaattttttctcagaccaatgtctgagagagtttcctcaatgatttcttgtagtagctttatagtttgatgccctggatttaagcctataatacattttgatttgatttttgtatatggctagagataggggtctagtttcattcttctgcatatggatacccagtttttccagcaccatttattgaagagactatctattccccagtatattttcttgacatctctgtcaaacatgaaccttcaaagtgtttgttatagtggttgcactaattacattcccaccaaacgtgtacaagggttcccttttctctacatccttgccatcatttgttattgcctgacttttagataaaagccattttaagtagggcaagatggtatctaatcttaattacgttaatgcatgatgccattgactgtattgacttcttagtaataatcagggcttcttgagttcggtttccaattatcttcataattttagtttgagttctattacttacctcttttctccaagatcacttaaaatagtcatggttattataactatagaaataaggcatggtttattataacaataaaaacaagcttatattttagttgtatttgcacatatataaaactataacttaagccattgtagaagaaaaagttatttattctctagtttattttccctttttgaaccaaatgagaagctgaaaaagcaactagattttggaaatacaggcatgttttctgtctgttttccctgtgttctttacatcttgtatcctctttgtctactgaaattccacatgtgcttccaaatttagtgcaaactctttccactgaggacttttcagtctattccaggccatggtgaacacacttttttttttctcaacagtgttagtaggtacagtcttcttttctccgctaattaactatatgtgacttcctacatttctagtatcctcattttacttttttcttatacttttttcccatgtgttcatgtcttgtttctccaagaatatagtaagtacttcctttgagactgaaaaatcacatcttacaatttactttccctgtcaagcctggatcaatgtctcacacacattaagcaatcaataatttttgtttgttttatagaatgcagagatgcatggacaacgctctaggccaaaagagtgacacacaatatgctcggcactgtggccaaatcagatcctttacataattttgctaatcttttgttatttatgcctgttacatgaatatcttaaaatttataagatgctggtatagcttcacagtatgattatggccattttagttaactttaaacacatttttagaaggcatttaaaaaatcaacaagtgtgtagtttagaaaagatgattcagaattacactaaataaatatacatacaaattatgttttcttgcataactatctattcgacaaattaaaggtcagcaggatgggattacactctcagcctaattcatgctctgtgaaaatgaaatatactgacattctatattctactgggacacatgatctgtacctattttaagcccatggctcttcacaatccattgtttaaaaatagatcagttctgaactttggagacaggctcagaagggcattaacctctttcttgacagttaagtttgccattttgctctaatcaaatcagtataagtctgctcatgttaaaaatagacattcttgctttgtacacattccaacaggcactcataaacagaaggttctacctagttctattaggttctactaatgaatctaattagtttttatttttaaatatactgccagcatttatagaagtatacatgagtcttatgattctaacatttcaatatcaaattttgatgctaaggcaatgtctccaggaaactggctgataaaatgaagggaaagcttactagcagattgtttgaatacattccaaaagaaatggggcatatgatattgctgggtttggtgtccctcctgagtactggcctgataccctttgaatcaccctttcagcacttgcaaataactacatacaattagttatttaaatgtttgtcactccctaaaatataacagctgtaagagctctatcctatttttcactgcattgtagtaacattaagagttaaattctactgtgtacttactatgtgccaggcacttttctgcatttttatgtgttttgctcacttaatctttacaactctgtgaagcagttatgatcattattcacatttcaagatgagaaaaatgaagtacacataagttaagaaaatagctcagagttgaacatctagttagtagcggagctggatttaaatgaggcttgtggaaggagggccatctggtaatcgtgatgtgaaatagcccctcagtagtaggttctcatccattatgtgttatatagctgaaaaattgcgtatacttattaatggtggtacagaaaatcacaaaaaggatttaaactatcccaaacaatgaagctttggatatttctcagcagccaggggcaaataagagcatgttaagtggatgggaggagaatcaaggaggagggctctccagggaaagccaggtcaggcagcaactgagagggaggggaggatactagggattactgaagccaactttgcagactcatacatttgactagacacagccagagcgcaaccagagagtacagattagagataatgaatataccacacagtaatagttttaatttaaaatgctatgttttggggtaacatcttaagaattttcctcagaaaactgtaatgttcctttactatctgacccaagtattttagtgcacagtggaatgataattttttaagatgactttacaatcacttcccagaaggctgacaattccagtggagctcagtgtgcaggacgtacagcctagcttgaggatgaacaacacacaactgttatctgccactgtgaatcttctataccttgaagtgtctcaatatttaggtttggacaggggaacttgaacaattgtttgatgagtcattgacataatctaggtagaaccggtgtagcaatggttttatccaatttgggctgctacacaaaagtatcacagactgggtggcttatgaataaaaaaaaattatttctcacagttctggtttggaggttgggaaatctaagatcaaggtgctggcagactttgtctagtgaggggccacttcctggttcatagacagtgagctttttgctgtgttctcctcatatggcagaagggatcagagatcactctgggacttcttttataaaagcactgatcccattcatgagggctccaccctcatggcctaatcacctcccaaaggccccttcctcttaacctcctaatatcatcaccttggggattaggatttcaacatatgaactgggggcagagggcataaatactcaccttagtagcaatataaaagaaaaaccaacatattttctatctattccatgaatgtgattgggttatagtgattgattagacagaacatttgtataccctctataatggtaccttcctcttcgccccaccatctttaccccatcctccaagtgagctctgcattgaatgactaatgcataaacacggagaacttttaaaagtttttaaagttataaagtatttttcttcttaaagttaaaaagaaactattttttcacataaaaataggatgttatgtcatacagtgcatataccaaacataatcacagaggaatctaaagatgccagcatgcttttgtaatacattaaaaatacatggaccatagtataactgacagtgatactaagaaagttctgtggacagaagactttgttttgagcatcacttttcttatccatataagcacaagcactactgttctcttggcaaaatgctgtctctaagctttaacactcagtcactctgagatgatttgccaagtaggtaatccttatttattgtgtacttattaattttttccacgaagtaattacaaaatatgtactatctgagggttggagtcatagaggaagttaagaaagatagtccttgcttttccagatcctgagttcatatagcagaacagggaatgaacaaataaatattaagggcaaataagacaatataataatatgcatacaacaaaaacactgatgtgattgatggagaatgactgagagggaactaatttggatgagcttctcagggaaggcctcttcaggagataacatttgtattgagatttgaacaataagaatgggctagttatctgctaaaggtgtttcaacaatttgtctctaacacacaaaaaaagataaatcacctaatttttgccacaaaagtgaaaataggagaatgctttcaataaagtagtgtttttgaaatatcagctaactgaattaattttatatgcatggtatgaggtttttgtaagaggtttcaaagttctcacaaatgtagttcttaccgccattttacatcttcgggcttcacagtattaaaacacattgaaaggagagtctgaactataaaatggataaaacatagtacagacttaactgataatgaatatagactaattttaactttctttaccactgcattttacattctttctctacttttaggcaaaagtcatttgtataagtttgtgagacaatgaaggtatgacctattcctcacttttataagtttctgaattcccagacttgtgttaaatcactgctcttaactatatattaatgcctcaaattatgcaatactttcataagctttcttatttaatgaagtattttaggttgaaatcatactataagataacatgttgttgacataaaattgaatttatgatgagcaattctaatcatgtatattagatgtgtgtatacacattttaatatttttatcttttgtcacaaaatacatatcaaataattgaactttgcctttctggatatcctagttcactcatttagcatttatttgtcattcaatgtcttctatgtgccaggcactttctagacactaagaacataacagtgacccaaacacacctttgcctaagttgattcctcctctcccaagtgaaacacagcttttgaaaggtgaattgatatattttactgctttttagacattttttgtaatctatcactgtgacttgaatgtagtaggtacataatactccaatttgatgttatatttctcatcgttcttactaaacttttcttcaaaaatcaggtctgggtttttagactcagtgtcattttagtaataacttgttatctttctgccatacgtttctttactttcttattctactcatgctttttcccttcaaataaactgttaacttatgtatagcattaaacttagacctttgtgtgattctgatattagaaaagcaaaagctgaagagtagggaagcacatggagaaaccctgttttcacctttacaaggtgttaactggctgagcatttcatgcttccacttctaggatctctcattttattaagcagtcatgattcttagtatgattttcattcacgactctgttaaagaagaccttttactcagtaaatatttcatgacttcctactgcatgctggttactagaaatacaaggatattaagcacagctcctatccccaagaagctcatagtctttaaagagataataaactaacaaatgataaatgctgtgagagagacagagtagtgacagaaaatttatgaatgaggttaggtaacttataaatggtaaaaatgcttacaggaaagtagaaggtaagctgagtagaaaggaatgaagatacggtagcatgaagaaaggcaaaaaggccatcaatagcatttattttccaggaaattgtcaataatactctatagatgaagcattaatgtgaagaaaggaagactaaggcaggccatgaagagcctctgtgtcatatgaaggagtttgggtgttttccctgaagggaataagaggtcatgagcaggttctaagaagaaagttacattgtcaaatttgggttttatatcaatcaatatggtagctctgtaatggaatgcattttagctaattgacattcaagccagggagaaaagttgtgacagatgttgaggtaatgttgagaacctgaatatggcatttaaatatataaagaaaaaatattagtcacaatttagcaattgaatgattgtaggaattgaggaaataaaaggtttgtcagaggatgcacgtaaaagtgaaaagtggatattttttccagtgaagatcagtgtaaattatggtgtggcaggaggaagaatagtttttaatttatgtatgtatttatttattttttgagacagagttttgctcttgttgcccaggctggagtgcaatggcatgatcttggcccactgcaaccagtgcctcccaggttcaagtgattctcctgcctcaggctccctagtagctgggattacaggtgcccaccaccactcccagctaatttttttgtacttttagtaaagactgggtttcactatgttggtcaggctggtctcgaactcctgacctcaggcaacccacctgcatcaacctcccaaagtactgggattacaggcatgagccaccatgtccggctgggaagaatagttaataaaacacatgacacagaaaatgttcttgttatcttcattatatattaccttgagaattttctgcctagaagaatacttcccatttaagggtacacattactagggttcatttttattctcagttgtgctgttgtctttctgcagtctttcaatgagattttattctggaatcctaacttctccatgccttcttagaatatatgcttcaatttatcttgtctttctgtcttttgatttgatatttattcctgatactgtctgttggattacctttgtctccttgctatgatctgtctcactctactttgaacctctccaggcccctgagaatccaatctggttccagtgtcctgaaattctgcttttcttgtgaagaagttttagatttaaaaagcaaaatatgttgatagagtttttttttttaaacaactgataccagggtcttcaaaaagcttatggaaggtgcatattatgaaaaagctatatatgaatttcctattttctttatcaaaataaacttgtagaaacttcttacaacacatctgaataggatctagtttaaggcactaagaagaatgagacatcagttttaaaatagcctctctcagagcgatatgaattataaaattgaagcaggagcaaacatccaattcatgctgaagcttggatggaagaatgagctatccatctataaactgctaattcatttggggcatcatttccataaagttttagtaaaaaatcctttttgcattccctcaatgagattttaactagataacatttccttaacttcttggaatatatccttcattctatcttatctttctgtctttttatttgatctttattcctgatactgttttgtaaagaatgcttcacagaaactttatggaaacaatgtcctaaatgaatcagccgttcacagatggatcactcattttaagaaggaatgagacaatgttgaagatgaagcccataacagcagatcatctgcatcaatttgcaaggaaaaaattcaacctgtttttgccttatttgaaggagaccaatgattaatagcggaaacaataaccaacatcgtagacatcacaattgctcagctttcacaattctgactcaaaaattaaacttaagcaaactttccactccattagtaccaaaaccattgcagccagatcagctgcagataagagtggagctttcaatggaagttttaaacaaatgtgataaatatcctgaagcatttcttcaaagaattttaactggagataaaacatggctttgcaagtatgatcttgaagacaaaacatgataaaaataatggctgccaagagatggaagtggtccagtcaaagcaaaagcagactggttaagcgcaaaggtggctcatgcctgtagtctctgttactcaggaggttgaactgggaggatcacttgagcctgggaggtaaaggctgcagtgagctatagtttcaccactgcactccagcctggatgacagtgagaacctgtctcaaggaaaaataacatctgcttattatgagaatattttcagagagttagctaaagctttagcagagaaacacccagggaagcttcagcagagtcttccaccactacaacactcccactcactctgctcatcaaacaagggcaattttgtgagagttttgatgggagatcattaggcatctaccttatcatctcaatttggctctgtttgacttatttttgtttcctaatattaaaaaaatctgtaaagggcacccatttttcttcagtgaataatgtgaaccagattgcgttgacatggttaaattcccaggaccctcaattctttagggatgaacaacatggctcgtatcattgcttagaaaagggtcttgaacttgatagaggttatggagcttatgtggagaaatgaagtgaatatttttacatttatcttttaattccattttctatgatctttttgaaatcttttcatatatttctttcctttttttttttttgagatggagttttgctctgtcactgaggcagcagtgcagtggatctcaactcactgcaacctctgactcccaggttcaagcaattcccctgccttagcctcccaactagctgggattacaggtgcatgccactacacctggctattttttttttttttgtattttttattagagatggagtttgccatgttggccaaactggtcttaaactcctgaccacaggtgatccacctgcctcggccacccaaaatgctgggattataggcaggtgtgagccactgctcccagcttatttctttcttttaacaaaatataaaaaattgaagtatatttccaaaagcaaaaatagttatacattctaatttgattgagaaatttgtagggaaaataaactaaccaatagcagatatttagcctcatatttttaaaactcttaactggtatcttatggctattcaaaaaatataaaaaacttttagtgggtacagaaatttagataagtttataaatggtgaagatattagttggaatacaaatacttgtttttaaacttatagtaaacatactaggaattttaacaaaatttgaaaacatagacgaaatgttccttgcacataggggactttcaagacaaaagtggagaaaacaaatatgaaaaaataataataacatgggtagaatggataagtagcactcttatattacggactaagtacactgagggccagagaaaggagatataagatccagtctcatagctgatcaaataagataaatagaaataaataggtattatttgaattcaattttcccaagagaggagagacatttctggaacacatgtggtaaaggtgagaaatcataactgattttttcaaaacagcaagttgcacaattttgttgtaggccactttgcaacagacatgacagtgggggaaaggaaagctggagatttagctgtagtcagagtatagagggactggaagatgagcttagggagtctatacttgattcaatttataatgcaaagactgaaagtttctgagcagagaaatgactaacttatgtaaataaaagattaatttgaccgtggtattttaaatggtagtcagagaaatcagaccaaatgctggaaggcaaactaagggaacagtgaaaatagtctatgtgagatgctttagtttaggacaatggcagtgggaaaggaagcaaaggcatgaatgtaagatgtattactaaagttaattgatagcatttgatgattggatgtacagagcacagaaagaaaagctgcaaaatagggctaaagttttacattccaaataacttgtgagaatgactaaagaatgtacagagagactttaagagataaaatggtttaatgatggaagaaaaatgacttcattatataatctactacatgtgtgggtgcaggggatatcatttagctttagaggaaatgaactttaaggcaggaacttagaactacagtttatagaattgaaatgtgagataatataaataaaagataataaattcaaagatacagaatgaaaatccaatggctcagaaatgttgcagtgttaaagaagccaaaaaaaaattaaaaataaaaaaaatatatatattgggagagattcaggaactgtgttttgttaacagcataaaaagtggtcccagcatcttagaaaaattatcaataattaacaggtgtattagtatattataatgctgttaataaagacataactgagaccgagtaatttataaacaaaagagctttatttgactcacagttcagcatggtaggggaggcctcaggaaacttacacttatggtaaaaggggaagcaaacatgtccttcttcacaagatggcagcaaggagaagtgatgagcaaaaggggaagaagctccttttaataccatcagatcttgggagaactcactcactatcacaagaatagcagcatgcgggtaactgccccatgattcaattacctcctaccaggtacctcccatgacatgtagggattatgggagctacaattcaagatgagatttgggtgggaacagagccaaaccatatcattccacccctgccccctaccaaatctcatgtcctcacatttccaaaccaataattccttcccaacagtcccccaaagtcttaattcatttcagcattaactcaaaagtcaacagtgcaaagtctcatctgaatcaaggaaagtctcttctgtctatgagcctgcaaactcaaaagcacattacttacttcctagatacaatgagggtataggcatcaggtaaatacagctattctaaatgggagaaattggccaaaatgaagaggtaaaggcctcatgcaaatccaaaataagcagggcagtcaaatcttaaagctccaaaatgacctcctttgactccatgtctcacatccagggcatgctgatgcaagaggtgggctcgcatggccttgggcagctctatccctgtggttttgcagggtacagcccatctaccagctgctttcatgggtggggattcattgagtatctgcagtttttccagttgcagggtgcaagatgttggtggatcaaccattctggggtctggaggatggtggtcctcttctcacagctccactaggcagtgacccagtggagactccctgtgggggttctgacctcacatttccctaccacactgccctagcagaggttctccatgagggccctgtccctgcagcaaacttctgcctggacatccacgcatttccatacatcctctgaaatctaggtggaggttaccaaacctcagttcttgacttttgtgacccccacaggctcaacatcatgtggaagatcccaaggcttggggcttgcaccctctgaagccacagcctgagctgtaccttggccccttttatcaatggctgaaacaactgggatgcagggcaccaagtccctaggctgcacacagcaggcagcctgtgggcccagctcatgaaactattttttccccctagacctccaggtctgtgatgggaggggctaatgggaaggtctctgacatgccctggagatattttctccattatcctggtgattaacatccaacgccttgtcactgatgtaaattgctgcagaaggcttgaatttctccccagaaagtgggctttttcttttctactacatggtcacgctgcaaaatatttcaaagttttatgctctgtcaacttttgaacactttgctgcttagaactttttttccactagataccctaaattatttctctcaacttcaaagttccacaaagatctctatggcaggggcaaaatgccaccagtctctttgctaaagcataacaagagtcacctttgctccagttcctaacaagatcctcatctccatctgagaccatctcagcctgggctttattgaccatagcactttcagcattttggtcaaagccattcaacaagtctctaggaagttccaaactttcccacattttactctcttcttctgaaccctccaaacggtttcaatctctgcctgttacccagttccaaagtcacttccacaatttcaggtatctttgaagcagtgcccaactactctgtaccagtttactgaaatagcctgttctcatgctgctaataaagacatactcgaaaatgagttattcataaaggaaagaggtttatttgactcatagttcagcatggctggggaggcctcaagaaacttacaagcatggcagaaggggaagcaaacacgtccttctttgcttggtggcagaaagaagaagtatcgaccaaaagggataaaagcaccttttaaaatcatcagatctcgtgagaacttactcactagcaagaacagagcatgtggtaaccatccccatgattcaattacctcccacggggtccctcccatgatatgtgggaaatgtagaagctacagttcaacatgacaggtcattgacaactttcaaatgaaaaactttggtaaagaagctaagaccaaaccataattcattgagtacatagaaaccttttgagaagattggcagtaaaagaaaggagagggcaaagaagtgtaagaaatatgaataatggttggcagccaagatggctgaataggaacagctctggtctacagctcccagcgtgagtgacacagaagatgggtgatttctgcatttccatctgaggtaccgggttcatctcactagggagtaccagacagtgggcacaggacagtaggtgcagtgcaccatgagcgagctgaagcagggcgaggcactacctcactcaggaagcgcaaggggtcagggagttccctttcctagtcaaagaaaggggtgacagatggcacctggaaaatcgggtcactcccaccctaatactgcgcttttctgatgggcttaaaaaccggcacaccaggagattatatcctgcacctggcttggagggtcctacatccatggagtctcactgattgctagcacagcaatctgagatcaaactgcaaggcagcagcgaggctgcgggaggggcaccctccatggcccaggcttgcttaggtaaacaaagcagccgggaagcttgaactgggtggagcccaccacagctcaaggaggcctgcctgcctctgtaggctccacctctgggggcagggcacagacaaacaaaaagacagcagtaacctctgcagacttaaatgtccctgtctgactgctttgaagagagcagtggttctcccagcacgcagctggagatctgagaacaggcagactgcctccccaagtgggtccctgacccctgatccccgaacagcctaactgggaggcacctcccagtaggggcagactgacacctcacagggctggctacttctctgacacaaaaactccagaggaacgatcagacagcagaatttgtggttcacgaaaatctgctgttctgcagccaccgctgctgatacccaggcaaacaaggtctggaatggacctctagcaaactccaacagacctgcagctgagggtcctgtctgttagaaggaaaactaacaaacacaaaggacatccacaccaaaaacccatctgtacatcaccatcgtcaaagaacaaaagtcgataaaaccacaaagatggggaaaaaacagcagaaaaactggaaactctaaaaagcagagcacctctcctcctccaaaggaacgcagttggtcaccagcaacggaacaaagctggatggagaatgactttgatgagttgagagaagaaggcttcagacgatcaaactactccgagctacaggaggaaattcaaaccaaaggcaaagaagttgaaaactttgaaaaaaatttagacgaatgtataactagaataaccaatatagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaagaaaaggaaacaaacaaagcctccaagaaatatgggattatatgaaaagaccaaatctacgtctgattggtgtacctgaaagtgacggggagaatggaaccaagttggaaaacactctgcaggatattatacaggagaacttccccaatctagcaaagcaggccaacattcagattcaggaaatacagagaacgccacaaagatactccttgagaagagcaactccaagacacataattgtcagattcaccaaagttgaaatgaaggaaaaaatgttcagggcagccagagagaaaggtcggattacccacaaagggaagcccatcagactaacagcagatctctcagcagaaactctacaagccagaagagagtggggggccagtattcaaagttcttaaagaaaagaattttcaacccagaatttcatatccagccaagctaagcttcataagtgaaggagaaataaaatactttacagacaagcaaatgctgagagattttgtcaccagcaggcctgccctaaaagagctcctgaaggaagcactaaacatggaaaggaacgaccggtaccagccactgaaaaatcacaccaaattgcaaaggccatcaaggctaggaagaaactgcatcaactaacaagcaaaataaccagctaacatcataatgacaggatcaaattcacacataacgatattaactttaaatgtaaatggactaaatgctccaattaaaagacacagactggcatattggataaagagtcaagacccatcagtgtgctgtattcaggaaacccatctcatgtgcagagacacacataacataggctcaaaataaaaggatggaggaagatctaccaagcaaatggaaaacaaaaaaaaggcaagggttgcaatcctagtctctgataaaacagacgttaaaccaacaaagatcaaaagagacaaagaaggccattacataatggtaaagggatcaattcaacaagaagagctaactatcctaaatatatatgcatccaatacaggagcacccagattcataaagcaagttctgagtgacctacaaagagacttagactcccacacaataataaagggaaactttaacaccccactgtcaacattagacagattaacgagacagaaagttaacaatgatacccaggaattgaactcagctctgcagcaagcggacctaatagacatctacagaactctccaccccaaatcaatagaatatacatttttttcagcaccacaccacacctcttccaaaattgaccacatacttggaagtaaagctctcctcagcaaatgtaaaagaacagaaattataacaaactgtctctcagaccacagtgcaatcaaactagaactcaggattaagaaactcactcaaagccactcaactacatggaaactgaacaacctgctcctgaatgactactgggtacataacgaaatgaaggcagaaataaagatgttctttgaaaccaatgagaacaaagacacaacataacagaatctctgggacacattcaaagtagtgtgtagagggaaattcatagcactaaatgcccacaagagaaagcaggaaagatccaaatttgacaccctaacatcacaattaaaagaactagaaaagcaagagcaaatacattcaaaatctagcagaaggcaagaaataactaaaatcagagcagaactgaaggaaatagagacacaaaaaacccttcaaaaaattaaagaatgcaggagctggttttttgaaaggatcaacaaaattgatagaccgctagcaagacgaataaagtagaaaagagaaaagaatgaaatagatgcaacaaaaaatgataaaggggatatcaccaccgatcccacagaaatacaaactgcccacagagaatactacaaacacctctacgcaaactgactagaaaatctagaagaaatggaaagatttctcgacacatacaccctcccaagactaaaccaggaagaagttgaatctctgaatagaccagtaacaggctctgaaattgtggcaataatcaatagcttaccaaccaaaaagagtccaggaccagatggattcacagccgaattccaccagaggtacaaggaggaactggtaccattccttctgaaactattccaatcaatagaaaaagagggaatcctccctaattcattttgtgaggacagcatcatcctgataccaaagctgggcagacacacaaccaaaaaaaagaattttagaccaatatccttgatgaacattgatgcaaaaagcctcaataaaatactggcaaaccgaatccagcagcacatctaaaaggttatccaccgcgatcaagtgggcttcatccctgggatgcaaggctggttcaatatatacaaatcaataaatgtaatccagcaaataaacagaaccaaagacaaaaactacatgattatctcaatagatgcagaaaaggcctttgacaaaattcaacaactcttcatgctaaaaactctcaataaattaggtattgatggggcgtatctcaaaataataagagctatctatgacaaacccacagccaatatcatactgagtgggcaaaaactggaagcattccctttgaaaactgccacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctgggaatccaacttacaagggacgtgaaggacctcttcaaggagaactacaaaccactgctcaatgaagtaaaagaggatacaaacaaatggaagaacatttcatgctcatgggtaggaagaatcaatatcgtgaaaatggccatactgcccaaggtaatttatagattcaatgccatccccatcaagctaccaatgactgtcttcacagaattggaaaaaactactttaaaatacatatggaaccaaaaaagagcccgcatcaccaagtcaatcctaagccaaaagaacaaagctggaggcatcacgctacctgacttcaaactatactacaagtctacagtaaccaaaacagcatggtactgataccaaaacagagatatagatcaatggaacagaacagagccttcagaaataatgccgcatatctacaactatctgatctttgacaaacctgagaaaaacaagcaatggggaaaggattccctatttaataaatggtgctgggaaaagtggctagccatatgtagaaagctgaaactggatccctttcttacaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttataagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagacaccatctcacaccagttagaatggcgatcattaaaaagtcaggaaacaacaggtactggagaggatgtggagaaataggaacacttttacactgttggcgggactgtaaactagttcaaacattgtgaaagtcagtgtggcgattcctcagggatctagaactagaaataccatttgacccagccatcccattactgggtaatacccaaaggactataaatcatgctgccataaagacagatgcacacgtatgtttattgcggcactattcccaatagcaaagacttggaaccaacccaaatgtccaacaaggatagactggattaagaaaatgtggcacatatacaccatggaatactatgcagccataaaaatgatgagttcatgtcctttgtagggacatggatgaaattggaaatcatcattctcagtaaactatcggaaggacaaaaaatcgaacaccgcatgttctcactcataggtgggaattgaacaatgagaacacatggacacaggaaggggaacatcacactctggggagtgttgtgcagtggggggagggggagggatagcattaggagatatacctaatgctaaatgacgagttaatgggtgcagcacaccagcatcgcacatgtatacatatgtaagtaacgtgcgcattgtgcacatgtaccctaaaacttaaagtataataataataaaataaaataaagaaatatgaataaccaagagcaagttattttggtccaggagtgatctgaatattctagtgggaagaaggcagatttctagggaggaacagaaagatgatgcaaagcaaagaggtggttattaatgttgcaaagtgtttgaatgagataataggaaatgaactgctcacagcaagtcattgtcttatcagggtccatgagatgatccaggaaagtgaagatgggaggaagaataggaatcaaaaagaagaatcagtttgataagaatgagggggagaaaaatggggacaatatagacaatgaggccacaagaaggaattttaaagagccagaaatacagacaagagaacagttctgaggatcataaatagaacaattttccaatacttttttcaacatttaagagcttatgtaggtgagaagctaaagaagataaggacaaaatatcttaataagtttaggtttttctttagagtaacgtggactagaagattctccatgaagagagaaaataaacaatgattatgtattatgcatactgaggacaataaatcttacctctctcagaggatcattgagttcattgagaatattttcctcatcaaagattttgccttggtatctgtgttcatagtaatcatgtatcttctgacgcatatcagctggtaacttatggaatgacatgtattgttccacttgcttatactgtaaggaagggaaaataaaattaaaaaaaaacattgttagggtgtatcagaaatcatattattttgttttgctatattcaataatatttgaatactcagttacaaaaaaaaagaaatcctttaagatgaaggaactaatttacctgggtctaatgtacctattttgtgttacataatgtataaggcattttatttaggtgcacatttcatggaaagaactaagatatcgtggagaggaggcatgaagggagttaagagtgaatttaagggagtagctacagaaaagccagtgatggggcaaaaacaaaatgttatgctatttttttaaattgagttctaaaagaagtatgaaattgtttggctgtcgatttttaagaaaaatctcatacctatggatagtacaataggttttatcttaggctttttggcaaaagatcagaatctaattaaatttggaatcgacaggcagggagcttggcaggtatttgcagatcattcatacttcaacaacacagatgccctgtaaattactgagaactaagagactatggcaggcttccaatttaggatttaggagaatatcacggtgagactagatccacattactgtatagctgaaagttaacttagacactgaagttcatttaaacaagtaggcgtcaactgtgattgttttaagaactggggagggcattgcttttttggaaggctgatcttcaggcttaattcccgagattgattctattgacctatctgcctatttatatttatacacacatgcgcgtgcacacacacacacccagagagagagagagagattgtttgtaagtagcatccctgcatccctgatagtcaaacaggaccatataagcatggatattacctgggtgcctattagaagagaataatttcaagcctcatccaagacctatggaataagaatttgcatcttaaaaacgtctccagatgactcacgtgcatagatatacaccttaaagtttgagaaacaatccctaggtgtttcaaatgcagggggtcataagaccacacactgaaaaaaaaataattaggtcttaaaaattttgtttcattgtatagatgacagcatcgagtacaaattttaatagttggtaacacaactggataaagatgtcaaaataatatttttcctcatgtaacacacatttgatatactttatatggacaagattttctgaaatattttcttgataacacagctctgactagatctagatctcctgactctttgcccataattattgtaattgtacttggtaattgataatagacctagctaatgagaaacagcaacccattttattgcatctcttcattttttccaacatactttcattttgcaaaaaaattatattgtttgaacattcccttttgaacattagtaccctcaaaggaaataccactttgtcgtgagactttctttgataaccagactgtccatcaaactatttaaagcctgaaggcctatgtacatctctctgaagtaacttgcttgctcaaacactacttggaggggtgagaatctgaaaccttaactgacacattgagatcttcatttctactttcttttccatgcatctcagaaatatgaagagcagcactgaaacttagtagtattttattcatttttgggaaattagtgcttgtatgcaaagacctactaatctagggaaaatataatctgctctatctctgtctctgaatttggaaaattaatccctttgtagctaagaacaaatgttacatgtatagttattttatttttatgaagcttagggttgattgaatctaattgtttttcctcacacaagtcatttaacccttccagatctcatttatgaatcaacaataagagagtatttgactaaatgatcttccttttactttcaaactaaaattttaaagttatatgactatttcttatcatttattcatattgtttgaagtttgaatctatattactattttaagcattcattgactcatagtaactattgatctagcaaacattaaatgattattgtatgccagtagttctcaaggtgtggttgccaaaccaccaatagcacttgggaattctttataaatacacattcacagtctccactccagacctactgaatcagaaactctacatttgggacacagcagtatgtgttttaacaggtccttcatacacaaaaatttcataatcgctgctatatgccaagtactgtgtcatcttaggacataaggaagcatgcttgagtgagcgtgggggaaacaaagtaaatttagttttcagcaagttaagtttaagatgcccatagcacatcctaatgcctctatgtaggtcaggcactcagagaagaaaatatatacatcattggtgactaagaagtcactaagggaggatgtgtcaaatgaggcgaaaaggctaaaaagtggaacttatgttttaaaatcagctgagccaggagactgattaattaagggtactgttaatacctgccaagatgtgagagcagaaccagaaaaacatgattagaaaatccaaagaaggattaaatttcacagggggtgtggtcaaaaggaatctattctaagaaaacaggtactgaacagtggccagtgaatttggaaattaggtagtaatctctgttagaatacaacacactaaaaacaggagctttttctttttctttttgtctgtttctcccacacctaacaagacttgcaagaatgtatgaaaatatcacttccatgtgatgtgaataaaaataaccaactattctttgaaaaagacacttagtagtggtagtcagaccgtgaaacaaactagatgttacaagtaatgtgtaagttggcaaagtcaaaaaatgataaaatggcaaactttctaatagttgtagtaatatactatatgcaaaatatgacttagtatatttagtagtcacagacaaatagatttttgaaaagcaaggatgccaatacaattctttggaaacataagatcaaaagtttattccatcagatctaaagagactataaaataattatcacttaaaattctaatatatttttatttttaaaagtttctgtataattataaaaatttataaaagtatgcatgtacatgattattaaaaatgagatctaacaagagtgtttataaaacacggcaaggatccagtttcaaacccaccagtctcacttttccatgttaaaaggtgtttaatccatatcactaagcaatatgcttgttcccgtttcttatatagataattacaggcattgtttataaactaactgtcataaaatggtgttttgccacttacagtaccccaaatcttcctttctcatgctatagctgtgtcactagtgttaattcttaccttagttgctttgtacctttatgcaccatgtttactattatttcttgttcagataactctaagatactttaccaggtgaaagtaaaaaaactccctcgttcactttcatttgatgacttctgtcatctctaatgttacaatgtaaaggtagattataactttgttcctataattggaacttccaaactcatagtgttaacattactctggccatgtaaatatttaccacaaagccaaatggtgtgagtatttgatgacatttcctttcttgctcatcagtagattaacaagacttgttcatccaatggatttgttaatcctgcaattgctgatcacatttatttcttgggtaattagccttcatttagtattattttttttctagcctccttatcccaccagatagacattgagttttttcttcaaagattttcctatagaatttctctttacaacatccttggtttggctcagtatttctaaatgccatgtttctgttttggtttatttattcatgttgctggaaaaaatccccaagtaaacgactaagaaagattgtatgttttctgaatctttccatgtctgaaattgtctttattaaactctcaaagttgactccatatagaattctaggttgaactcctctagttggatgttgaggctttggatctgaatttgattctctatgctggatttgatttgtttcttatctttatttaatgtatttagtctctgcattttctcctacctttctctgcattccctacattttctctatatttccccaacatttcccctacattctagaatattttctgaaattcttagaaaacattaattccgcctccttttcgttgatcatttatttctgtacttttaatatttttagtttaaaaatatactaatatgagatttttgaaaatgatttttaggccgcttttattctccaaaatatgtgacatgtctaaatgtgaattcaaaattaccctctagatttagtttcagtaatgtctttggtgacctttccctatgtgtgtatgttaggagtagggatcatgttacaaagcagactgtaatgatttgtgctatggtttggataggattctccaaacttcatgttgagattttatccccagtgttgtaggtgggacctattggaaagtgttcgggtcataggggtggatccctcaaggacaaagattatgccctccctcaggcgtgagtgaattctcactctgttagttccctagagagcttgatgataaaaagattctggcacctctcccctctctctctccctcttgcttcctttctcaccataaggtctgtgcatactcctgctccccttcactttctgccatgagtggaagcagcctgaggccctcaccaatactgatgcccaaacttgaactttccagccatcagaattgtgagccaaataacctttcttctttattaattacccgatcttaggttttcctttttagcaacagaaaaatggactaagagagaagataatggaaaatagaagtggcaatggaaatcataagtataataaccatcacgagctgtctatgaggtgagaactgacgaataattgaagggaatagaaggcaatctaatagaagaatagtaagcaatctaaagaattttaaatcacatttatattgtttttatatccatgaaatgatacccttatttataaaactgaaacaccttagtttatcccctactccttcatcccaatccttaagacatcaccaaattatgtaagttttacctaccaaaagtttcaataattttccatttctctgcatcaccattctggtcaaagctactctctctccttcaactcatgaccagcttcttaactacattcactgtacctatttatacatgtcttcctccaactctaactcattttccatgattcagacagagacatctttttaaaatgttaatctaattgtcacccctaaaggaaactaaaaatatttcaccccaaatatacctctttgacatattttgagatggctgttcagagggcctgcagacaggaatagccctacaaaggtgccttttgtggggagatttgcatctgtggaggcaataaagtgaaataaataacagatgcaagcaagcttttcctgacgccccgcttgtccatgtctaggaaagattaacagagagtctgacaccttttaagatctgacagagaaacatttaccatagactatcacctattttttctgagggctgctacctgtacatctgcacaagattgcctttactccatgcctttcttcttctgctctaactctgacaatctgtcttgccatgccataagcccctattctttctgtaaccccaagatggtataaaagcatcaatgattgggcatttctttgagttttcatattttgtatgactcctgtacatacatgtgcagataataaatttgtatgcccttttttcctgttaatctattaccagtttgtgttatagagtcagattacaggtcttcaggaataattttatacacttcacattcctggaagacagggataagaagctgtccttcccattgtattagaggggcaaatcacataaattgaaaaatagcaaattattaataattactcatcaaatcagagggaactttaagttcatgattctatccccatgtctcaaatctataaaacactgcctataagaagttaactttttactttcaggaagcatcaaaaaaaaaaaaatatatatatatatatatcacctgatttataatatctcaagataattttatagtgtagtgcccacagtagagtcttacctgtggggtatctatgtgtacattggcatcaatacacatcaactactatttttgtgaaacaaaagttaatacttttttttaaaaggcaaaagactttttggtgagtgatggaactaatttccatgttcaaataaatcataaatgctacattaactagctatttgaaagtaggctacactagctgaaatagagcttctttaaactttatttctaggacaacctacagcatcagatgaaaggcatagaccttcatctgccaaaataaacatgcatgaaaatgtgttacaatttcaagggtgtttacacatatctgagtgtcaatttaaaaatatctgagtatcttaactgaccacattaagttttattggcattgtaaaactccatgagtgctggaaccagtggtgtcagtgtttaatctacactatattcttgacttttgactttgagtatatatatatatatatattttttttacctttcagtttttcagttttttatatgtcaatttgaaatgataatatctaacgtactgggtgccatgaaaattagtagtgatactgcatgtatgttatgtgataaataataaataataaatagtaattattagaaatatcattaaaaagcaaacaggttaaaaatccagttgaataaaaatatatgtctcattctcaatataaacacagcaatgctaaaatggtttctgaagaggtatttttcttatagaataaaaaagtataaattttatattccagtgactacatgtgttttaaatgtaatttgacaaataataataaataataagaaaatatttaaaattgtttgctcttcaaagaccaacaatcaactttctttttaacttttttatgtttaaataaataatcactgggcttatgactaatctatcttaatttttaccaagaaaaattctagtattgccagctatttacacagcaattgaagccataatttctctttattatcctacatttaaaaatacataaattcatatatatagaaaagctgggtaatatgctaattcatttaacaagtattgtttctagaatttttgcagcaagattgaactattttcaagaactatgctataaacacagcaacatcttcaatgcatatcttttagaatttttttttctcagtaaaaatgtgttgctggttattttatgaaaaagttttaagtcacatagtctttacatagtaagtcatataatcataaaaataacatgaaatcttcctgaatttgattttcaataaaatgaatgggaaaaaactaaaggaaaatcacaaatgagggaaagcagatggtttagagatttgtttgctttttagcagaagtttgagtcagatactcctattttatcttcattttatatttccttttttggaaagctgggtaacaaaacatagatttttctatggaataatgattatttagctctcaagatatgcaaaagcttttttgaaataaaatatgtatctactttgcatggaaaacagtcaaaattccaactgaatgtaattttattttattttattttatttgtttttctctgagatggagtttcactcttgttgcccaggctggagtgcaatggcatgatctcagctcactgcaacctctgcctccagggttctagcgattctcctgcctcagctgtagctgagattacaggcatgcatctccacgcccagctaattgtgtactttcagtagagatgggatttcaccatgttggtcagactggtcactgcaacctcggcctcctgggttctagtgattctcctgcctcagctgtagctgagattacaggcatgcaccaccacgcccagctaattgtgtactttcagtagagatgggatttcaccatgttggtcagactggtcactgcaacctcagcctcctgggttctagtgattctcctgcctcagctgtagctgggcttacaggcatgcaccaccatgcccagctaattttgtattttcagtagagatggggtttcaccacattggttagactggtcttgaattcctgacttcaggtgatccacctgccttggcctcccaaagtgctgggatattacaagtaaagcgtgttattcttccatccagaataatctcttccaatacaaatagtcatttgctttcttgcttatggaacttagctatccattcagatatttcacaagaaactatactttcatctatgtaaaaatgcaggattcaaaagaacttggaagttgtttacactacataggttttcatttatcaattattattattatgtttttattttataatggccaagttgagcattgtttttgaaaagtcaatttaacattgtttaagatttaactaagcatgtaattgaaaaaaagtgatgatgagactttagtgtatttagcaattagaagaaaatccttgattactaaacaagtaaattgtctgtctaaaacatctttagtatgttaatttatttgtaattatggaataagggtcaagggttagatgattggtagaagtagaaaaaatcattataaccattgtaatacagctaaatgtgtgcttgaatatttttaaaatcctttagttttcctgctctaaatgactttaaactttattactatagttttgcttggtgtgtgtgtttgtgtgtgtgtgtgtgtgtgtgtgtgtgtgtatctatctatgtgtagggaaatgatctggcccttaattgaacaagagtatggactgatataacatgcctaccatggttaactcaatcactcttccatttttttaaattggaccatttaaagcattttatgctgtctcaactttcctatttccttccctcaacagtttctttcactcacagaagatgactttacatagaatttcaaaaagaaatagaagcttttacttaagaatatctactaactcatttaaagagaaatctattttttctccttctgtctttatttctcttataaacaatgaaagaagtgtttctaattccatttaaagctactctttcacctgtatttgaatgtccagttacaataattaaaatcataatcatatctaacccttggatattaaatgctgttttcctggcactcaactaaaccttttactcatatttacctacttaatcctcataacaacagtgtgagattgctatcatgatcttcattttacagataatgaaattgaggcacagagaatttaaataacttgcataaagtcacacagctaattagtgctgaagccaggatttgaatctaggcaatatggcttcagactgtgctcttatttgctgcatgacattcttgtcatcaaaaaatgactctctattgatcacaagtagccctctacttaccatcctatttttcttctctcctttctcaaccagtttcttgaaagtgtggtctacttttgttatctaactttctacttctcattaaaaccttcaattatagcttccattccttctatttcactaataatactcttgcatttccattatttcctgattactaccatgatacttaattagatatttcacaaatataccaaatatatatatatacatatttgtgatctgaatatatataatatttacatattatatatataacatattatatatatatacatatatatatatatatatatatatctgaatagtactgaacaccagtggttaacactattgatgtcccatacaacgcgtctttccttgtaagctgacccacctctgacctcaactgtaccaatggtggaaagtccatctcagggtttttgcatcagggctctctgggaactctagaaaacttgctcagctcaacctagagttgcatggtcttctggggggtgaggagaggtgtaggttacaccacataaggcaacgttcaaccaatgagggacttgagtctccagattaataacagcccctatccttcagagaaacaagtataaggttcattctacacagttcctcagagagtgtcagtaggactaagccccaattgtctataactaaaaaaaacctcaataatatacccttcattagattttcctttttcatggtgatatggtttggctgtgtccacattcaaatctcaacttgaattatatctctcagaattcccatatgttgtgggagggacccagggggtggtaattaaatcatgggggccagtttttcctgtgctattcttgtgatagtgaataagtcttacgagatctgacgggtttatcaggggtttccgcttttgcttcctcctcattttcttttgctgtcgccaaataagaagtgcctttctcctcctgccatgattctgaagccttctcagccatgtggaactgtaagtccaattaaatctctttttcttcccagtctcgggtatgtctttatcagcagcgtaaaaatgggctaatacacgtggtcttactactcctgtttcctaatcctgattcttaaagttcttcctcagtaaattacccaccccaaattcttttattaggctctgctactaggagattccaaactaagacagtattacaaactgagcccttcctcctaagacatcttttcctgtgtcttctccatccacatatggttctggctttcgtgtttcttctttggctgctcttttcagtctcatttgttggcatcttttaatagttggtatttccaaagactatgcccaaggccgccttttcttttcaccttacgtattttccttggacaatccttcccactcacatgacttcagttactatcaatataccaccaatcctcaagtcaatggtccagcagagaacaaatccctgatctcgactcgtaagcctgttttccctttaaacatctacccttacaacatgtttcatgggcacatcaaacgcaaaattgaaattgtcttcctttttcctgcatgtcttcaagtcaatggtccagcagagaacaaatccctgatctcgactcgtaagcctgtcttccctttaaacatctacccttacaacatgtttcatgagcacatcaaacgcaaaattgaaattgtcttcctttttcctgcatgtcttctctatccaacctgcagcctaggctacagacttggttttgggtacactcatgtctctgtttccaacgtattttactttaaattttcacaaactaaccatcttgtcatttgggagttaatttttaatgccactttctctgagtaattttccctaatgcttgtcttaaatgttaatgtaaattaaaataatatgagaattttgttaacatgaagattcacattcagtatgtatggggttgaaactgaaattttagtatttctaacaagattctagatgatgctaatgctggtagtaagagaattacagtagttgagatttagattagattagatgagctatttattctcctataacatcaagtatttcccatgcattggctcttttcacactattataatttctactgaaattacctgtgttctttgcagaccataagcttcctgaaggtgttcaataattgattaattaatatgttctaaaatattatttattgtcaaacatattatttagtctttgtcaagaacaagctttgaagtcctttttaaaaataaaagtgccatttttttcatacgatcaaatatatgtaaatcatttaaactcttttacatatttttatttttatttttcatgttagatttagggaattcatgtgtttgtttgttatatgggtattacatgcataatggtggtgactgggcttctaatgtacccatcacgaaactattgaacatagtactcaataggtaatttttcaaccctcacccacctcccattctccacccttttggagtccccaaagactattatctctatctttatgtccatatgtacccattgttttgctcacatttataagtgagaacatatgatatttgattttctgcctctgaggtatttcacttagaataatggcctcaaactccactttgctgcaaaggacatgattaaattattttttatggctgtgtagtattccatacatatatacccacattttctttatccattcaactgttggtggatacttatgttggttccatgattttgtcattgcgaatagggctgtgataaatatatgagtgcaggtgtcttttttatacaattatttatttctttttgggtcaataccaagcagtgggattactgggttgaacggtagttctatttttagttctttgagaatctccatatcgttttacttattttttttaaaaaagacttctaatgatacagtagaaacaagcaagtcagacacctatttgttgtcataaaatacctacttttcttttcctcaaaggcaggtaatatgccttaagcagttgaaggatccataacttagtttattaaattttaacttaaatgacctcccatttaatttcttaaaattagatgattaaggacataatgtttcataaattataaagccaattagcataaatctagagatactatttcacaccagggctaaatctactaggctatcaaagattgcagcttttagagcaataatttagataagtttgggtgattaaaatgatgcaaatattttgaaaatgtgggtgcactgattgttgttacattatagcatttgtgtgtgtgtgtgtgtgtgtgtgtgtatgtgtgtacattctcttctttgtatgttatgtgtgtgtgtggtaattcttcaataaaaaaaggaaatttaattatgtttaacttccattccattgggaagatatattcactatctgcaataaacagttaagtgatttttaagaaataatatattcctaatgtcctttttccacagccccaacaaattttttaagcttttagtgatagatgataaattattatgtaagccctgtatatatatgaaaatgcgttaaaaacagtaatagcttaaaacaggacattgtttaaatatcactaatcttctacttcattattttagtcaaaatgtttcttagcattagtaatagcttgatttacatttgtaaatctctctagtttgtttgaaatgcaactgtttctatcttattgtttgtagctttccaaatttaaagcaactgaatatctgaggatatggataattactaagtgtaaatataatctgaagaataatttttaaatgactcaccagcaaattatcatgcagaagcaacatatctgatgaagaaaggagcatttataatgcttaacttttatctttgtatttgtttttcaaaagcgaaaaattctaacaaagatattccttcagtacaaattaaaaacctgattttctttacattcataatataaaacaagatcaaaatggatgttatcatggtacttatcaagtctgaatgatgtggtattaagaattaatgaagaagaatacataaatattaagaagatttagtcaacatctatgtttcagatccaagtattgattggttatcagtctcaacataaatcaatttgaatttttgtgctaatccaatgggggaagtgacaaaatataaacactataatgatcattagtaagtacctactaaagagtaaggagatgttattagaagaaagtgcaaagtgttgcacagcagaataagaaaaatcatagtccttgagtcttaagttaaaaatcgagtcttatttaagtaaaatccatattggtgaatatcaatgattgatttcaaaagaattacacacatatatgtatgtattttgtatacatacatgtcatattgtatacaaaagatccatattggtgaatatcaatgattgatttcaaaagaattacacacatatatgtatgtattttgtacacatacatgtcaacatacagaaatatgaatttctgaatgtaagactatatatgtaacataaattgaacaatactttgaattggcagtgagtttttagttacctgttgacactgctttgaatttgatagcaactcaggaaagtagcataaccatgatgcatgatgttaccagtggtaagaggacaatttcagaaaatcattaatggagtttataaaagaaaattgatccaaactttctcaacttggctagtatgaaactaatggtcactggttgatctaaatctaaaatttgactggcttttcagaaccaggtcaccatcgtaacttccaaataagtttcctgaagtagtgagagaagacaaagaacttccaatctaactacaataaagtcaaaactaccttattaaaattagaaccattcatcaatacaaaacaaaacaaagtttccaggtaaacttcacagcaataattgagagcagctgcttactaaaaatttagggacctaatacaaagccagtggtttcagataaaatgagggtgagtcaagataaatgtgttatcaggcaggaagtgaattggctgttatgggttatgcaaagtaaagaagtgaaatgcaagaaatggaccaataggttactggatcttgactgtagatgaggtgagaagagagcaaaacaaaggagtttccagttgtgttccactcaaaccataaaggaaccaggagcttacactattcctaacaatcaataagattttttgttaatttattctaatagaagaagagtagattctgtttcaattaatacacgttttgtgttctcacattataaacaatttctcaaaatcagctgaggctgcaagataatgacactaatttgatcttttcttctattttcgccatgctgaatgatcttaaggagacacatttaatccatagtcactgctaatgaacattttcttagtcaggtgtttaactaggcaatgagaaaattatagcaaaaacataattatttttcctaaagttaagatggtgggctaaggatgagttatatacatttaaatagaaatgataaataatggaataatttgatttggaaattattctagtgcactatttctcttctatatcaacattaattgatagagaatgttgttctctcccagttttatggctttagactctatatatactggtaagacctaaatatgtatttctaggctagactactccattaaatcaagattcatatactaaatggcctaattggcatctccacttgggtgtgtactgaagatttaacatttaacgcatccaaagctgaaatccttcatcaaaacctcatcttactagtgttctgcatatcagatgagtttctaccgggagctggggccaaaagtgtaaagtttttgttttgccatatttttttctctcatacaccgcttctgtcagcaaattttattagatgtactattttttccattacagtttcattgaagtataatttatataaaataacatccataaattaagtgaacattttcgtgagaaatcatcatcatgtggaggttttagaatgtttccatccgttccaaaagttccctcattcaccttcatagctaggtcatattccctcccctggtcccaggaaatcactgatctgttttgttgtcactcttattttccctgttctagatttttacataaatggaataacatttattctttttcatgtggcttttttttttcactgaggacaatgtttccaagatatattcatgttgttgcatatatccgtagatattttttctttatttctgaataatattcctggatctacttttataatgtatttacctgttcacttctattgctacaaacagcccagtttaccatgaatttgtatgtgtatgattgtgatagccttctaattggcttgtttccccttttgactgctcataattcattcttaactcagtatctcatattatccttctaaaatgtaaatctgcccatggcataactttgtttaaactttccaagtattccaatcttagatggaaagccaaaatatttcaataacctgtatgggcctatgaaacacagcctttcatggcctatcctattactgtccttgctcactcagccccagcctgattggtactctcaagcctggaaggagagtggggagcacaagagtaacagagaagtcaagaaatagatatattcgcatctgcctgcatcatcaatattcttcagtggtaagaaatttaaaactataatattagaataatacagattatagaaaatcctgtaaaaattgaacatttgacaagtgacattagtatataccccaaaacactccagtgcatgtatctaaatatcactgcattgtagttttacttggtaaaggagtgtgaacattattgacttaattgattattccggatcatgagcataaagaaatgtaattatagcgcaagctaaaataagatacctaagagataagagaacctctaggaataaataatgttagctctgtattttcttaaatcaagttttcaagtttgtaaataacaataacaaaaatagcaggaacaaaatatactgtgctataagacctgatgtatgactggaattgtacttccactggggttgaaataaaaaaaaaacctctcagttaattttttcttgggaaaaattataatggtatgagattcatattttctttgaaaatataatagcatatatatgttttcactgttaatggagtatgttaaactactgcaatgtgaagaatacaaggttgtttttgttcttcaaatagacataactttatataaaactacaattaccaaatttgattaaaaacggacatatttatccaatattatcaaattaaaacaagttaaaaaaacctgaatatataaagatgttaactgaaaaacttgatttataggtactccctattttcctgccttaaaaataatgtcccattacattaattttttttctatattaaagtagatattttagtgggtcagaaacattgggcatatattcaacatactgttataggtcatagtagaaaacagcacatatacaccttgtttcacagccttctgaacttcaacatcagagttttgaagaagagaaccttcctcattgctacctttataaattaaaaaatataaactaaatgtgtaaataatagaaactacatatttttattgatgttcaaagtttttatataattataaacaattctcccaagagataaatataatttatcatatatgtgtgtgcttatttattcttttccaaactataatgccataaggccacagagctagctattgtcatgcgccagcaataactagaaacattttcccctgattgtagaatggtattcttactcttcactgacacaaaatgcaaaaaaatgttaaagataaatattttttatgtgcacacactctaaaagaagtaatggcagtatagtgatgatggagctaaatggaacatttaaaaatgtaaattttaaaaattctttttactgattctccataaatatgtatatttcgaggagtttggtgattttatttgctaggataagcaaaggagaggagaaaaatatatcaaagctagagaaggaagaaaacattacagacgttgggacatatattgggtaaactgtggacaatgagaattttgaaaagcagtcttaagatacaacataccagaatctctgggactcagctaaggcagcgataagagggaagtttataacaccaaatgcccacattgaaaagttagaaatatctcaaattaataacctaaaatcacaactagaggaattagagaaacaagagcaaatcaaccccaaagctagcagacaggaaataaccaaaatcaaagctgaactgaagaaaactgaaatagtaaaaactgtacacaaggtcaatgaatcctggagttggttccttgaaaaaattaataacataagtcgatagaccaccagctagactaataaagaaataaagagaagatccaaataaaaattcaacaatgacaaaggggatattaccactgaacccactgaaatacaaaatcctggctgggcacggtgactcatgcctgtaatcccagcactttgggaagccgaggtggacagatcacgaggtcaggagtttgagaccatcctggacaacacagtgaaaccctgtctctattaaaaacataaaaattggctgggcttgggggcggtcgcctgtaatcccagctactcgtgaggctgaggcaggagaatcacttgaacccgggaggcgaaggttgcagtgagccaagatagcaccatttcactccagcctgggtgacagtgagagactccatctcaaaaaaaaaaatatatatatatatgtacacacacacatacacacacaaggtgtatatgtgctgttttctactatttatattatatataaaatatatataatatacattagtaatattatatatgaaataaatataatatacattatattataaaaaatatataatatacattatattatatataatatataatataatataattatatattatattatgtatattatatataatgtaatatatatagtatatatcatataatatatataatataattatatatatattatatatataatataattatattatatattatatataatataattatatatatattttatatataatataattatatattatatatataatataataatatattatataatatgttattatatataattatattataatataatacaattaatataatacatattatataatataatatatataatatatattatattttatatataatatatatttatatatatatttatatatataatatatatttcatatataatatataatatgtgaaatatatatgttatataatatatatcatatatattttacatattatatataaaacatatatattatataaatatgtaaattatataaaatataattatataaatatgtaaaataatatatacttatatataaaaatatataaaacatttacatataaaaatatataaaacatttacatataaaaatatataaaacatttacatataaaaatatataaaacatttacatataaaaatatataaaacatttacatataaaaatatataaaacatttacatataaaaatatataaaacattttatataaaaatatataaaacattttatataaaaatatataaaacatttatatataaaaatataaaatatttatatataaaaatatatacgtatttatatataaaaatatatacgtatttatataaaaatatatacgtattctatacacaaaaatatatacgtattctatacacaaaaatatttacgtattctatacacaaatatatgtacgtattctatacagaaaaatatgttcgtattctatacacaaaaatatgtacgtattctatacacaaaaatatgtacgtattctatacataaaaatatacacgtattttatacataaaaatatataagtattttatacataaaagatataaaataaataaaaaataatatataaaaataaaattatataaaatatatatattttacatatattaaatatataaaatataatatatataaaatatatgtagtatataatatataaaaatataatatatataaaatacatatagtatatcatatatataaaatatatagtatataatatatataaaaatatatgtactttataaaatatatgaaatatatgtattttatatattttatatatgttatatataatatatattttacattatatataatatatattttatattatatattatatatattttatattatatattatatatattttatatactatatataaaatatatatttcatatatttaatatataaaatatatatttataaatataatatatattttatataatatatgtaaatatatattatataaaatatattataatatatatccctcagatatacatcatctataatttatattatatacattatatacatcatctatcatatacaatatatacattatatacatcatctataatatatattacatacattatataggtcatctataatatatattacatacattatatacgtcatctataatatattacatacggtatatacgtcatctataatatattacatacggtatatacgtcatctataatatattacatacggtatatacgtcatctataatatattacatacggtatatacgtcatctataatatattacggtatatacgtcatctataatatattacatacggtatatacgtcatctataatatattacatacggtatatacgtcatctataatatattacatacggtatatacgtcatctataatatattacatacggtatatacgtcatctataatatattacatacggtatatatgtcatctataatatattacatacggtatatacatcatatatattacatacggtatatacatcatatataatatattacatacagtagatacataatatatataatatatattatatacataatatatattatatatattatatacataatatatattatatatattatatatataatatatataatatctattacatatatgtatataatatatattatatacataatatatataatatatattatatacatattatatataatatacattatatacataatatatattatatattatatacattatatacataacatatatattatgtacattatatacataacatatatattatgtacattatatacataacatatatattatatacattatatacattatatatattgtatacattatatacattatatacattatatacattatatatatataatatacatatccctcagagagatatatatatccctcagagactaccacgatgaagaaatgggtaaattcctgaacacatacaacctcccaagactgaatcaagaagaaatgtaatccttatacagaccaataatgagtttcaaaattcaatcagtaataaaatcctgccaaccacaaaaagcccaggaccagatggattcacagctgaactctaccacatttataaagaagtgctggtagcatttctacttaaactattccaaaaacttggggagggactccttcctaactcattctatgaggccagcatcatcctgataccaaaacccggcagagacaacaaaaaaagaaaacttcaggtaaatatgcttgatgaacacagatacaaaactcctcaacaaaatacttgcaaaatactatgaatatatatatatatgtgtgtatatatatatatataaaaccatatatatgtagatagatagatatctttttcttcaagtgattttgtaaaacttatttttggttcatgggtatatatatagagagagacagagagagagagagagaactatactatagttcatggaaagttgaactatactatagtttgtcgacagcagtgtgggatttctctaagaacttaaaacaggatcaccatttgactctggaatcctattattcagtatatactcaaaggaatggaattttatatatatatataatatattatatataattatatataatataatattttataatatataatatattatatataatatattttataatatataatgtattatatataatatattttataatatataatgtattatatataatataatattttataatatataatataatattttataatatataatatattatacataatataatattttataatatataatatattatacataatatatttcatgatatacaatatatataatataatattttatgatatacaatatatataatataatattttatgatatacaatatatataatataatattttatgatacatattatatataagatcatattttatgatacatattatatataagatcatattttatgatacatatgatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataatatcatattttatgatatatcttatatataatatcatattttatgatatatcttatatataatataatattttatgatatatcttatatataatataatattttatgatatatcttatatataatataatattttatgatatatcttatatatattttatcttatatattatatatgatataatattttatcttatatattatatatgatataatattttatcacatatattatatatgataaaatattttatcacatatattatatatgatataatattttataatattttatcatatacaatctataatataatattttataatatatattatatacaatataatatgttataatatatattatattatatataatataatgttttataatatataatatgttatataaaatataatatattatatataatataatattttataatatataatatattacatataatatatataacatattttatatataatacattatatataatatatattctatatattctatatagaatatagaatatatattctatatagaatatatagatatatattgtattatatataaaatatgttatattacatatataacatatattatatatatatagagagagagagagagagagagagaaaatgactagagctgattctcttggcaatgtgtggatgctactagaagatggcctttaacgaccaggaagttgccctcatcagacaccagattggctagtgtcttgatcttggacttgtcagcctccagaactgcaagatataaatgttgcataagctaaaccaaaacaaaacaatcttctaaaatttaaaggatgatgataacaagcatgataacatttggctggtgatttaaagtttgcaaagaatgtttaatagtcccaactattccatgagtcatgcagggcagacgtgattatgtttatatcttcatgaggaccctgaggttcactggcaggaaataacattcttaataccattcagcaatttccttgtgtcactgggattctgaaccatgtattttatacatagaacacatgctcactttttttctgtgaattatctgtcatatattggtaagggagccagttaaaatcttctgtgactttctgacattatgatttcttagaagatttcaggtaattctaatgttcagccaggtctgagaaccactggtctagaataagaagagtgcaaccaggtgtttgtcatgtgagaaaaatagggcatatgaagacttgttgagaaaacttggaatgctatcttggacaagaaagtaattataagaaaaggtttgacttagctctactgtactaggcagaactagagaaaatggtggaagttatagagatacaggtgtcagaaaaatagaagccttgaaattcacagaattaaaatatcgcaataataaacgtaagccttgtgaagttgtagccttcagaaaactgctcaaacaaaaatggacaaccatagatcaagaaaaatggtggcagtcggaattcaatgcagatgtaaaaaataactagatctcagatttcaagatacttaataaaatttcacatttgtcttgagacctaattcccattcttctgttcatgactatttaatattttgtgcatttgttaaatattaataatcaaaacaaatgtgtttattaaaaatgatcttttttgcttctttctttgtggtctgatctattttttaatataacttttcaaatacttagggggctgttttttacacaatcacttgcaacctaatctttatagccttagttgacagactgcctgctgaaactaaccgagagcaaagttaatgactttggtaaggccagttaaaaaaaagtgatgtatttgagaaggcaagaaatgcaaacactccttatacctacatgttgacacctatctccctaagactcagcagtgttttagcttaattatttccggttttgtgactgacctacttgagatagttagaagtcaggtaggtatgtgactgggtgttactataaatacataagactataacaaattgggttgtagctcaaacctacagctagtggaagaaagcctcccaagagggctgtatagaaagatggtatttagtcttagaaataattactggcataagccctgaaagttatttatatagaatagaagaggtcagatgatattaagaaaggggatctccttaccctgtatcctcaaccagtactatacattaatgaattatgtgtataaagatgacccaaaagacatttaaagtgccttttgggtggtccaaaggagattaatacatatttagtatagaaagagacattcagaactggagggcaccacagagataattaatctgactatgttaattttacagatgaggaaaagaaacccagagaggcaaattcatttccacatattttatacctagttagcaaatgtcaggaagaaaaccagggttccaatttcctaatgcgtaatctttgtcattatccctcatcaaccctaccattcagcatgttttgttgttcttcagttcttattaattcttgggtcaaacttttatatcctttgtaactacaataattataaactagagtgccaattttcttgataactctagataaagaggcatttagaaaatgtgtccagcaagaaagaagtattccattctggagtaaccgtatatgttccatgtgagtttgagaacctgcctggagccaggcaacatcagaatatattctctacctctaactggaaaatttaagcacccctatctccatgtggaggttgataagtaattgttgtctatctatccattcattgattaattttccaatgttgggtcactgtttgttgtttttctttcatgtgcacttttttaaaaattatactttaagttctagggtacatgtgcacaacgtgcaggtttgtcacatatgtatacatgtgccatgttgctgtgctgcacccattaactcgtcatttacattaggtatatctcctaatgctatccctcccccagcccctcaccccacaacaggccatggtgtgtgatgttccccttcctgtgtccaagtgttctcattgttcaattcccacctatcagtgagaacatgcggtgtttgtttttttgtccttgctatagtttgctgagaatgatggtttccagctttatccatgtccctacaaaggacatgaactcatcttttttatggctgcatagtattccatggtgtatatgtgccacattttcttaatccagtctatcattgatggacatttgggttggttccaagtctttgctattgtgaatagtgccctaataaacatgcgtgtgcatgtgtctttatagcagcatgatttataatcctttgggtatataaccaataatgggatggttcggtcaaatggtatttctagttctagatgcttgaggaatcgccacactgtcttccacaatggttgaactagtttacagtcccaccaacagtgtaaaagtgttcctatttctccacatcctctctagcacctgttgtttcctgactttttaatgagctcttttctatgatacgctcctcttaatgtgaaacactatttaggaaaattttcatttttcatggtctctgaattgtatctaagaaatatggtatctaagaagtattacttttgagaaattaaaacttaaatttagtgaaaagtttgtgtatgtttgaaactatgtaaaggaaataaaacacaaatagcctgggtaatgtccaatctggtatgataacatgaattaatcaatttatgtctgtataattcatccaaagacacaagatacttccttatttttatgaatgtattatgaaacttctatttgtgtttttctgcttaagaatacaaataaaacattgtggttaccacaaatctgtataagatctatgaggaaagcttagactaacaaatattttcatggaatgcataacaaggggcttggatagtgctataaaacacaatcttagattctgttttttattaaaatactacttgatacagaaagaaaaccacatctgaaaattaataataaaaaccaataggaatgatggggagtgactctttaatgggtaaagagcttctgtttgggataatggaaaagttcgagaaatggatagtggtgatgattacatgacaaaataaagagaaaaaaagagaggcatatttacggtacagatatgtaaatatattcaatatatattaagtaaataagagagaacttgaggaacaagtttgaagagttaggatccatttgtcttagtccattcatgcttcaatataacaaaatatcttagaagggatactttataaagaacaggcatttatttgtcatggttctggaggctgggaagtccacaatcaagacatcagcagattcagtgcctggagaggtctgttctctgcttccaagatggtgccttgttgctgtttactgtgtcctcagataattgaagagcaaaaaggccaggcagctctctgaagcctcttttataagggtgttaatgccatttacaagagctcatgacttaatcacttcccaaaaggctccctcttaataccaacaaaatgggaattaagcttcaacatgaattttggagggacacaaacattcaaacagtagcaccattagtctctgtatattctatggatatccagcatatgtctagaaaacattctggaataatttaagttacataggagatttggttatggaggtactcaggttcaaaactgcagagttctgggttactaaatatgtttataataaatggacacatttttcatcagaagaaaatggtaaaaatgatatattttatgttacgtatgttttatgacaaaaaataaaaactagagcacataagacttcatggccatgacacctaataagactcctaataagaattctttgtacattttgtgcctttgttagacctgtagttcccattacacactatagaaaaagtagtattctatttttgtggcaaagaactataaggaaatcgttttattatttacaagatgggaaactttctggaaccacgagataagacatcccgttgcttgctcaaagtgagattaattaccttccttcatgtaaaactagaaaatattaaatgttatttcctcttccagagaaaatggcacagtcaagattagtgtgctgtgagcacagtgataattagcatctatcttcaggtaccctgaatcatacagagttttccattgaaggagagttgttatgatattgcaaagctcttttgaaggcaacaaaactagatttcctgttcaatttcttaaagttaatttatgtaagaatctcaataataattataggattagcaagtgcaatcatgaagaacatagcttgttaaggtatattaaggtgtataagcctcataaaataagatacttttgaaaataatttaatatttttgtaaaaatcattctgagaagttctttgaaccagcagaaacctatcctacgatataagataggaaaacaacttcagataagtttcttcccaaaacgtagattctagggtctctctcttctatcattatggatacatcagggccaagtgaattttttactttctactacatcctctctatatagataaattacaaactacaaagcaatggccatcagaaatttgaaacaaataaagtaaaaaagctcacttaaagctctcattcatgtaaagttagtatttttgtcataatgattctttcccatatgacaatccctcgtcccttactcctcacatggtcagctccatttcatccatcagggctaggtccgatgttaccttgctaaagagacattttccagattcatcacctgcctataatcctctcacatctattccatcaatccagcaagtcctgccacttctcctgcctgcataaatcccagaccttcccactccttgctatatccaagccatctctcaagcccagaccatcacatcttcctgggatctcttatccaattcccctgcttccattcttgtcctaactggacctacaccccacaccacagccaacatggtcttttcaaaactaaaaacaaatcatattatttccctgcttatacctttccaatggctccccattgaaatgtaaactaatcagacaaggagatgcctcctgatctggcctgtcttcctatttgagcttcaatcctactgtccagccattgtcctccgcactgactctgttcctacatcactgactttgaattgctagagcaagttagcctcttcccatctcagcggctgtgtactttctcttttctctgataataaaacatcttccttcagatgtttttgcattcttgtctcagcataagtgacacttcaccagaaaggacttctccaactaacccttctaggagaatagagtaactctcttccctccacatgttattccctatccaattactttgttttatcttgtttagagcacttatcatcatctgcaagcatcttatgcccttgtatgttttagtatttactacctgtgtacactgtaagctgcatgaagacagagacttgtcatgtttaatatggtaccctcagtacctagaaaagagcctgacaaatagaaggtactggatttgatgactgaatgaattaatatatgaattaactggataactctcattattctctaaattcttcattccttttcttcataacaccatattatatcatgtttatacacacacagatatacctgcttatttgcttcttttaaatttttgacttacttattaattgatttttggtctgtctcctccttaacctgtattctacatgaagacagtggtcatatctgtattatccgtatttcaaattttggaaatactttggtgtctgaaatattattagcactaaataacacctgatgaattaatgaatctgataaactattcaaacaagaagaatcaacaggtgtgccttagaaagtacatttccctttctgaattttatctcagatgaaataatgatgaaatcatgaaattacgaaatgatgaatacacccaattcttcactgatgcacttaagcaattgttatgattaaatgggggactttattgtaatgttaggaaaggaaaatttggaaaaatataactactacactacagtagagaaaactttggatcttgtttttcttatctctaaaatgtgaattaattgagattaaaatgatctctatataggaggtttgtcataacgtttgtttgtaaagtgttattgagtaaaaataattaactactattagagatgaagaaaatgagtctctaagagactataaaacttgttgtggtcatgcagttatgaagatgcagagctgggatttaacatttttcagtgtgatgctatcgtctatgcattttctactataccaattgattaaagtacattttaaaaaatgcaatgggcatgtattcagaattctggtaatttgttatagattactaatttgcatgttttattgctaccacctcctcttttaaattagtgtaactttttaaactaaggcttctgaaaataaatgattataattttaaaacatggtacataatttcaaaatctacacctagatttaaattccatgaggaggctgggcacgatggctcatgcctgtaatcccagaattttgggaggccgaggcggacgaatcacctgaggtcaagagtttcagaccagcctggcaacatgttgaaatcccatctctactaaaactacaaaaattagccaggcatggtggcacacgcctgtagtcctgctactcgggaggctgaggcaggagaatcgcttgaactcaggaggcagaggttgcggtgagctgaggagacagaggttgcagtgagctgagatcgtgctcaccactgcactccagcaagggtgacagagacagattctgtttcaaaaaaaaaaaatccatgaagaaatatgaaaactattaactttaattaatcaaaaataacttgggttatttccagataatataaaatgtttgttttttccacaatattttaatagtaaaatacaaaagaatcacagattctcttgccttgtttgtataccaagttagtaattccacatcctctgctccacaaaaaacaaaacaaacaaaaacaaccttatacaacatctgagaaacaggtaagaagttgctaccaaaactcctgaaattgattatatttatttatattctaaaacagtaaaatgttctgtatcctagaaaaagttttataattaatttttgccacaaattctctatctactaaatagggagaataactcatcaaagagtttgctgggggaattctaatgatcaaagcttaacagccaccgtatatactcatgtttcctttacatccccgtgcagtatttggtgtttagtaaagctgcttacaatgccaagtacatttcctttcaagtagataaaagccttgtgatagatgaatgtaataagatactaaaaacacccacagatatctaaatgatgtctatattacatccaatatagtcacagaaaatctttggaataatgtgagatctatggtatttcatattatttcaaagttcatactattttaaattaataaaactcatgaaaatcaattttctaaagtataacttcactgtttatatggccaaaagcacataaacagcactgcagaacataaatttttaagtgaagatttatttatatttcaatatattgctcacttaacattcttgtttactaaacacaggtgatcaaacagggaagaatttaattaaactgttcatcaaatgtttgatctttctcaaataaacttgtttttacggatggaaaaaaatcttagaataataaatctagctctcagtgaggtcttccttggatgttatggactaattttggaggttggaagaaaaatgcaaaggctgatctgcaaagcacttctgagaattttaagttcatcatttatctatggatttctccaaagcacatttgtttgggaaataagaatgctgctttgtatctttgtgactctgctagttagaggtataaatgtggaatctaatttaatctctttggatctcagttttcttatctctacaatgtgaattaattgagattaaaatcataatgaggatcataaatagaaaagtcttccttttttccagaactggagacttcaaaaaattaaacagacaacttttaaactaagaaaatatttgtgtcaatattgtctacatagcattaattatctggatggtaatttagcaatttaaaatgtcgatatatgctaacactagttagtcctgtgcacactcagaatactgactgttttctttattctgattctttagctgttgtgtgaatttagcttccagttaatatctaaaactgggttgagaatgggactattttatattatttttataaaacatggggacctaatatcccttattgctagattttttacattgctcataggagggattaccactgtaactgcataaagagcacttattaatttatgaaagttgagaaggtagtcattcgattttttttaattaaaaaaaggaaattgatttgtaaatttaatttcttaaatttgtgttttcatataacttcctggggcttgcaagagttgaaagctataatattactgccaagaagccaggaagaatgagtcatctagtcaggaaataaaggcaattaaggcttttaacctttcaccccttaaagacattttaacatatttcaatatgatcaaatctattgtgaattttctgaaaatctattgtaaagtttcttgatactttaaacaatatttaccgtatttgcaaggtatgtttcagtggttattaaaaatcccatttgtctttaaatactttaaaaactgggtgaaaaatcggaggaattaaatagtgaatgcaattaaatataaaatgtaagtttcggtgaattggcaaataaaattccacaattaccacattctacttgagtgccatgtgtctgtttgggaataatcgcattcttggctggacacagccgttgtgtgactcagagcctcatttcctcttacagcacatgggacccaatcctctggattctccaggaccagcttagctctacaatcctcctgccagataccactaaaacagaaggagctctcattgtaataaaaatacattttatgaattgaccacattttagtggagctggacaggagtccttcaaccagagtcttatctaaatcaattgaaagctatatgtcatggtcctccattgtattgtgccacagcagtggggacatttcagttgctgaatattatacttattgtacttaccatttttctgttcctccttcttgcttgcttatagatttttttttttttttggacagggccttgctgtgtctcccatgctggagttcagtggtgtgatcagagctcactgcagcctcaacctccccagctcaagtgatcctcccacctcagactcctgagtagctgggagtataggtgcgagccatcatgttcatctaatttatttttcactttttctagagacaaggtctccctctgttgcccaggctagttgtgaactccctggttcaagcaatcctcctgccttgaactcccaaagtgcagggattacaggcatgagccagagctcccagccaaccttttctctttctcttctgtcctttctgcgcatctacttttagcagctctgcatctacttatactgtgttgcttttctacaaagttcaaaggtggagcttagttcaggggctcattattactagcaatctgagctccaaatatgcaagttatttctgtaaataactaaaaaattgttcagtgctctaatcagctcatcatttggaaataaaatttaaaaatcttctcacgttaaaataaaattcagtattttatattctcattggaagaaaaacttgagtctatttacatcctttaatagaaatcttgaattctctctaaatatcacttaataacactctcatgctaaaatttacgatcatttttattatacatgccaatctaaatattttaatagaggcttttccaaaattgctaaagtaacttttaaatttttagttcattaattctagtaataacttcagtaagtgggagacagcaagaaatcttttaaaacaaatatactattgtaagataatttcacttggcaaagcttaagcaatgaatatggaatataatcatttatgttatattataatctgaatatatgttttgatcctttaagtaaaatactggtatagtcagaaaaaaagttgaaaatattttgtcccaaagtggtttatagttgtctcatatatatatcaaaagtttttaatttgtattttaagttcacagtatcaatatattctgttcaaaatgtatgagttacttcatatattcttcagagagaaacattttgacttcagaaagtaaactataatatcttactctcatattattgtttcatactatttatgatacaaataatataattatgttttatacaaatttccttttcttaagaatggcagagaaaaatccacgttagtgattcacaataaatgatcagattacaattgaaaattcaggggaaaactattggtaaataaatattttacatactgaattttttttaataacagtgatatctttgttaataaagaggatacatttaactaatgttttacttaggggcacttcattactcctggtaaataagacacggtgtataagatgcattctagataatgcattccaacatttctaacagatggcttaagagaagatagcaatttcgccctacattttattattttgccacttcttaccctgtatatctccacattctctgtcatctatcaacttacagcaccaggccatatacagtagtcctcacttattagtgggacatacgttccaagactcccagggatgcctaaaactgcagatagcaccaaaccctatacatatactatgttttattcttatgcatacatacctatgataaagtatgatttataaattaggcacagtaagagacgcacaataactaataataaaatagaacaattataacaatatactgtgataaaagctatgtgaatgtttattcgtgcaactttccatttgatatttttggaccatgatttaccacaggtaaccgaaactgaaaacaaaaatatggataagaggagggctatggtgactcaaagtctcagtggttctccattgcctaccaaaccaaatacagacgattttaggccttacagctactattgtttttcaagtactccactgcccattcaaaatatatgaacttcctaagaaattccaagcatcttcctagctcttcatctttgttcttgtatctgtggcacaggccactattttcccacctaaatctcttctctgcttgttccctatggatagagttgttgagtggtcacagttctgcttagttagaaaaaatttctcagcctccttgagtagaaatatattaataattaagttctcatcaataaaccatgagaagaagtaatatgcctgtcccgctgtgttctcttcctcttgtcatgagctggaagacaaacatgtctcctgcacagcttcaaacatgcagacaagaacaataccctagggtggtgctggtctctggaccggtagcagcagcagcatctgagatcttgttggaaacacaaattctcaagccccactgcaaatttaatgaagcagaaactcaggaaatgtggcccacaaatcagtgttttaacaagcttttcaggtgactatgaggcacactaaagtttggaaagcattgtcctaggtgatagtggaggaacaacttggatgaacctatattcacaaatggccatttggagcagtgtcatcccacttacccctctcatttcacaaagtttatttgtgaaatcatatagttctttaagttattgaattgttgagtctctgtcttacagaagtttagtatttgtcctaatagtatttttcaatatataatggctatttagtattcccaccctgtttaatatgtccacccgctaaaatggaaatctcacctaggtctctgcaagtttgcactggaaaactgtgtaacgccaaagaagaccaggccagttttgccttcctttaatctattatacacactgttgattaacattttttaaaaatggcaaatctaatctcatcactcttccatttcaaattgctactagactctcaaggcatttaggctacaagatagcatggttgcctaggcctataaggtgtcacctaaactgatccctatcagcctctccagtcttatctagagtcatttcacctttctctctgttctagctacactttctatctgtctgttcatgaactgtggtaagcttcttcatacctcagttttttctcatgaagttcactttcatgtcttacttctcatctttcaggtctcttctcaaatataatataatttcttcttctctccccccatttcaccctacagtattccatatgaatcaagtaaaaaatcttaaaatctcttatctcgcctgtacatttccactcatagcattaatttcctaaaaaaataatgtagtgctttctatgaatcattctattaggtgaaatatcctcctaaccccacccactatattacaagaagcttgatgagaggaggtaccatgtctacttgctcactatgtgcctagcatctggtagtaggcctgacacatggttagcattctgcaggaatgcatggagtgcaggaacaaaatagattatttgaagctcaaataacacgacaacttataactgaagactatttggatcctacttacttataaaaatgttgtttcctaaagttttatctattagagttatctctacctacttaatgggctcaaattcctgcttaacatatttgtattaatgattccatcagaaacaattttgatcaaggaatcttagattctaggttaggaatacgtcgtatctcatgcactgttgtgatttatttttctaaaagacaattttaattcagacttaccattgctaagtttttcaaaggatatccctttaataatgtacaatctcatcattccagaattcaaaactatttttggccataatctaggctatttcacactttccccagcaaggtagctattgtttcattcaaattagactattcaatatgtctcatacatctctacctcagggcctttgcacactttgttcctgtctgccagaaattctctcagaatttggacatttttctgagacatttctctcatggtgactaatcctgcctgctgattacctcttcattcttcaaggtccatttccagtgcatcccagtaaagcggctaaccaaacacaagttacatgcaggttgattcttgtcaatgtgggttcttatcagattagtggctccctggtcaccaggtttccctgtgaaagtgcttcacagtttgtttctatcttatgacatataaggaatacaaatacagtaagaatacttgaaagagaactttggggagtaaactcaaaaattcaaacagttctaaaatatcaaatgcataatcaattaattaaatggaaaatacagctctactttagagctataaaaagaagctaacatatgtgctgtaaaaaataataaatgtaaacagcaaaaaactaaattaaggtttagtatggagaaatctttagcactttgcacagtcctgaaaatgtgaatatctacaatatacatgtagggcattccagcatataacttagagcattgacacagaaattatcactggggaaaagggatgccatatgccacagtgggttatatcaaaatacaaagtttgaaaaatcatgggatatgtgatttacaattggtaagtttctgtttttctatttagttaaattaagtctcaaactccctcccttataaagacttactccagactttataacaacacttagttaatataaaaattatttgccccagatgagaatataaagcaacattgttgtaccaggagcctgatttgctagcaactccaatggctacattaagttattccaagcattgtcacactggtgttttcctgcaagagaatctcacagaggttcccagccctaggatctccctcgcctgagaacgtttggctctactaccaatttaacataccacggtatgttaaattcagttcccgggaagcaaagtacatgctgtagcctaataaaaaatttttgactaaggtactatgtgggagttgtactcaaggcattcttatttgtaaaggaaagaggaaagcatttaagaattatgaaggaaaccaagtgaaatgcttgattgaaagcacttggatctcagagctagctcttccccttaagaataatcctaatgcacattagggtatcaaaacattttttatttaagtactcagtcgatatgatttttcaaggtcaagatcattataacttcaaagtccctctgctcttctgaaggcagatgctactgaatgctacaaaatcagcaaaccaaattagtaactcaactaagcttcttgatgtaatgaagatgggctataaaacaggatgtaacttttttcttttaaaactaaataatggtattattcataaatgattatgggcattactccaaactgttcctctttgctcagccattattctagtcatatagcttaaaaaattgaagacttagaattacatgacaataatgacaaactctcccatctgtctttctgagagaggaggctccatcatctcctgaagcagaacacacccatgattagcccaagactaagaaatggcttcaaatctgatgagaggcactttgataatatgcctcttgctcccagggaaataaatctcagaattctagaagagaaagcagattgaatatttcatttctaaaaagtgatctgtgttcaagcaaaataaaaataagaaaatggtccttatactccctctggacagagagagtaaatacggtaaacaaatgactatacaatggcatgatcaagaaacattcccacagccttccaaaggaaaaggcagaatctatgtaaatagtgaaaggggtaaaagtatttaagggggtggagtgaaggtaagaatcacttggtatgttgagagaacaatgatccttaagaatttaaggatccttaagagttgatttggcgccactcctcctacatccaaatttttcttgaagagcatataaccaagaaagtatatatcttaaccataattattttattttaaatgagctgaaataaactctattgcaaatgggatttgaatagcttgaagataagagcaggttttggtccctcaccttttgtgtctgggtgtaccattagcttacacaaatttgaaatattaggttgatttaaaaaaattaaaaatgtatctatggaataaatttatgtggcagttctgattatgggccttcatttacaagaaaaaacaaggatctatggatcattaattaaaactaagcaattaaacaaaaacatttgcctgagctaaataggtttagaacattattttttggtatgattacataaaattgaatcattttatataggtggataatgattacatattactcctttgtatagctgagagagtacttacattaaactttaccttcttttccaaaaggccactaatagttatcatatataggccaggcacggtggctcatgcctgtaaccctagcactttgggagaccaaggttggcggattacttgaggtcgggagttctagaccagcctggccaacatggtgaaaccctgcctctactaaaaatacaaaaattagtcagaaattgctggaactcgggaggtgcagattacagtgagccaagatcgcgccacagcactccagtctgggcaacagagcgagactccatctcaaagaaaaaaaaaaaaagccatcacataaactctttccaagattaacaaaacttgataaatttgtcattttggagaagtttagcgtttttatttcatatactcgataaactgagactcagcacattctttggacattacataacataatcaatatttgaatctaggtatagaactggcttggtggcttggtatcttgtgccctgccattagaaagcacagtccattttaacagctcattttgcacctgccctggaattatgcagtctgattcacagtttcaggatgctattcagtccataaagggatttggaattgataacttcctcacatatttaaagttattctttggtcatattcaagttggtgatattcgtattttaatttacacaataaaagtctttcatgtatatcaagtataccaaggtgagttgcaaatccctgaatcttaagtcatgatttatattgtgccaaaattcttgctcattgcagaggaagaagtgaacacataaagcttctattactatagttatttgattggagacagcgacataactagaaataatagtcagcttcccaggagtgtccaaatgtatgaactaagatgtagtagtataaaaaaccaaggtgatcaaaaggagtttcatttcatgaaggctagatgaagtgcaattatatctagaaaagaaagtgaccactcaaaatcagtttaaaaataaaagaatggtcatcatggagaatttgtctttataggttaattcctttggacattagtaacttaaaatctatggaggcttggcatgaaggtcaaagatggcatgttaaatcttcagggcacacacatttacactaaaaaacacttctgtaagattgtttcaatcaacatttctgaacttatttgaccagggcattgtttttatatatgcataatactgacatgtctgtgaaggacgcttttggattagatgagataaagaatggtctaaaaagatgctaagtaaggactgaatctgtcctatgctcattgaactgcaaatctgagagttatcagaatattgcttatgtaagaggctgtcttctatgcaagtaaaaattgtaaatggtgatctgaggatcataactcctggaggcttcagtcttatcaattctatatagagatcagggggtaaggtgagatttttcctgatagaactagtgaatacattccttttgagagagaagttcctctgctgtgagtccctttacaacctcttttgggataggggtgtgaaaaggctactttctaacacctgacatatggaaaacacttgaaacaaattcatttaaggatctttgaaataagctcatgtggttgggagacatggatctggactctgaataatatctgacaacatgtaaatagtctgcgaacgctggagtctgactatcgtcaaggaaggctagatacactctcctcattggtttggaagagaaggaagaggagtgctaacagattgtctaggagaaggatgcatgagtgcttctctgtggactacatctgaaccatataggagggccagcattccattttgggtcctgcccaagagtgcctcctatcagaattttacctaaataaaaagataataatttagccaaaactcaaagagggcaaatcaccaaagaagctgcacattactcatccactatgtaaagccatgctataagattaaattgaaatttaaacatatacttttcataaaaagtaaaatttttaaaaagtaacataatgtccttaagacctatcctggattacactgactaaaaaatgagtacagaactttagaactaaacttcttggcagaacttggtttgtagacctaaaatttattcttttaatacaaaaattagtcaggcgtggtggcaggtgcctggaatcccaactacttgggagactgaggcaagagaatcatttgaaccccgaaggtagaggttgtagtgagctgagattgcaccactgcactccagcctgggtgacagagactccatttcaaaaaaaaaaagttatattcttttaatcagctgttcctgattacattgttccaaatgccagtaaataccaaagggttatactagttttcttgtcctctatcaaacacttataagatcaagaacttcatgatttgaattattacaaaatcataacatctttgcatacaaatatctatgattccataagtgaatacattgagtttccaagttaaacttggctaatacaggaaatttaaaaacataaactttgtgaacttatttaatatgcaataaaatgctaatcactgcaatcctggaagttaaacatttgttttcttattgagaaaatgtatagcaatgatgcagaccaaaaaaaaaagtgtgaaaggggcatttttattaaaagcaacataaaatgaaagaaaagcaacagtgtaagagaaacatcagatttaacgtgatgtagtcttatcttaaatctccataaaattagcccaaattcctttaagtatataattcttagttaaattcagcattgtataaagtctcttcttccttactacgttcttcgttctttccaattcatttggagactatttaaaaatgaacctcaaaccaatttttgtggtttatcttttcattacttcagtaataaaatgccaacttgctcactgtaatagctagtggcagtataattatattcaagggaaatatctaggttccctttctcatattgtgtgattatagtgttgaaaacttctgtaaataaagcagtaactgaaaacttctttggatgttttgaaaacaattctgagactaagctgttatcactcaccaagagaaatattctagagccattttaatcattactttcagaaacgctctttggcaaggtgcatgactctgtcaggatcaacaaagcccctacattacacattgttccattaatttaaaatattcttatttatctgtcagaaagctactgatgtttggtcaagaatattagtactgtcccaataccctatatttagccctagccaaagaaattcttcatgtgggaaaaaaaaatccaatgaataaatcattgcctatatttactttttctctctcttgtgagaaaagtttagagcagcaatcattttaattagcacattgagcataagaatgcatcacagcagttgttatatccagttttaagactggagagtgtggcgacttatctagatatacaggtaatatatgctcagctaagcatatggattgtaatataaattatgattatagatgagggggggtacagagggacatgcacaatagctgcctgtctccacttaatcagctaacatttttctaacacatacgagagaagggtttattttaactattgacatatgatagaaaatgagccatgataacatcttctatcagctttttacattttgaaatatatagctattttttctgtagatgtaaagtcacatttaaaaagattattattcaactgagaaatgagaagcaaaagatatgagaactatcttgaagaaacctcaaaatatcaaagaagatagtgtgtttttactttaaacattttatctcttttttttttttatagaggagatggtgtagttatcttgaacacaattcaatttactggttcaggttagctggttaaagacattggcgataaataaaacaaattaccttctcttgatactgccgcctcgaagaatccagagactggattaaagcggtggcatggccgacaaacatggcatagcaggtggccccgacgatcatgctcagcatggtaatccagaggtcagacatgctgactggggcttgggctccatacccaatgcacagcatgtgactcatagctttgaagagtgcgtatgaatactgctttccccaagaatcattctgcaacataagataaaaagaaaattgactgagccattaggatggcagaatgaaaagtgagtaggacctgtacacagaagcattataaaatactgaatactggaaaaatccttacaatggagcatttacaaatgtacttctcactaactgtgaattaaatgatgtttttcaaatctttcttactatgatgaagtggaaacagtctgctgttacttacatgcgctttgtcagttttaagtttgctgtttttaaaactaaaattccttttgggacaatggtatgccatgtaataatgacaagaatgaatgctttaaggtttcaaggaaatgtggtcaaatagtattaataatatatttgcaagctatgaaatgcagcagacagtatgacacatacaggccaaagtataaacatttttatcaaaaccatgaagttcagattttaaaaatccatattgatatagctgtatagtccttaccactacaactttccttaaataaaaatttgaacaaatatatattggaaatacaggtctgataaatggaaagacttccttgaagccctctctcgaagtgatgtatattgtaatttgtgtcaggattgaagacggctgaatcttgttggctttttataaaataataaaatgaaataggcaaaagaacatcttggcttatgtcctggagaaaacaataggaaatgctgacttctgagattatttattagttgtaacttctgatgtcatttaaaaaaaattgcaagctcaattttttaaaaatgctgtccaatgtatcttatctaatttttgttaaaatttaaattattttttggataaattttattgaactccctaattcaagtattacacaatttataaaagccagagcaaaatgaaaatgagggggctctggttcaaaatgcgggaaaaaaacttattaaatataataaaatataaagatttttcctttaaaactactttattatttataaaacctaatgtgataacagtgataaatgagtaaaaatataagcttacaaattttaaaaatcaatattttaatgtcatagttatatgtaataccataaataatactgtattaatgtgatattttgattggtcataaaatttttctggcttatttttctgaaattcatttcttagattatcaaaatttatacaattaacaactttattttcaatgatttagttgaaaatgacattagttgctcttggctattggaagattacttatttttaaatttaaatttaaattttaaattttacatatttttaaatttaaaaatgatctttctattaattcaaatgttattaaacctattaggagtattttataggctgtgagattagggtcaacttctgataatttatttaaaaatatatatttgagtacatttggagctgatgattttcatagaacaacttttcaataaatatttaacttatcatgccaatctgtttcataccaatttcacattgaatttagtttttatatctgaatttattttttaatttaactttttacttttaggtaattacagatttacatgcaagttataagaaataatagagagagattctatgtactcttcactcagcttccccagaggtaacatgctgcaaactatagaatagtttcatagtcaggaaattgacattgatataatgtactcatctcatttatagctcagtaatttaagtgtactcatttgtgtgcctatatgtgtgtgtgtgtatttatgtctatgcaattttgtcacatgtgtaggttcatgtatttattaccacagtcaagacacagaataattccatcacaagggtcacttatactgccttttattgaattgaatgttaaatttaaatgtatgcaaggatgttttagtgtttcttctgatatttcctgtaacttgtcaaggccgtgcaaaaaattgaaagtagtttcaagatttgcatataatttaaaatgcctgtttatatattgtattgctatatttttagttacaaagaaagtttaatttaaaaattatcttccttgttaataattggtttaatttaaaacttcatataaaaatcgtgttattttccatcaaatgtgagtcttaaatttaatttgtatttctaagtttatggacatctgctgtgcaattttgcagcagctttcaaaactggacattgtaaacactgaggaattctaatgactttctaaagtgcttactgccgtgcccatgtgtaaacatttattttgtaataatttatttacaaagtttactgcctgagtgccatgggtattgtcttggaatttaggtgggagatttaatatctgtttagatactacagggatggtcccttgggactgatgagcaagctctctactcaccatgggtgttctccctgcctgcatggatagccactttcatctctcacgactgcctttgttgctgctgcttctcctgctgctacagatagtcactcctaatctgggaccagtcctggtttggccacatcagggacacatagcatctagactgctgagtgatgcatatgctgccttgctgctaggccaattgcatgtctcctgtgcctacaggcctgaatctgtgtgtgtgatgctgccatcctgcagctctgctgctcatgttcacaccctgttgtcctagtggacttcacttacaaaacataagttcaaagataaaattattaagagtttcaagatggcaggagcagaacattaaaccaagcacagggttcttttgacagtgaggggctctgtgcaacttcaaggtcacatatcaatgaagccaaacctgcatttgtcaaattaactcttaaattatcataaacttttcaagctattttattttgaatagatatgggtagttttgtttgttgttaatagggttttccaacatcaaatttgtagatttaaacaataaaacagaagattgaaaagcccagtcttataaaccttggaactgcacatagttgctaaaaaataaagaaaataactagccccatttagctgaaaggattgaggttcttaaagtgaaattcactattatttaattataataaaagtcctgctcatattaaattatcctctctatatatgtattttcgcaaaagtaaaaaataagatttaattttaacacaagaaaattagttgtatgtcatattttaatatgtacatagtataataaactcatgcaaaaactcttattttggagaatgagcaaatttatactttactttatcagtgaaaatgtataatactcagaaatacatctaagatttccaaaattctagatggtccatgaacaagaaatggtatatttacatttactaaaatgtaaaatctaattcaagatttcctttctccacataagggtacagacaaggtatattgttaaagcatcttgaggtatttagataaaatggaaataataaaaagttcaatggggtgtcgagtggagactacactttatttctattggtattgtttatttctttttgtatgaatggaggcagggtatggagctggaaaagaaagtttaattcagtttttcagaataatacagctatgtctattctcatttatttcactagagacacaaaacacacacctgtgtatacatgctcttaaatgacttgaaataaatatatattaaaaatgctttttttttttttttttttttgagatggagtttcgctcttgttgcccaggctggagtgcaatggtgcaatctcaactcactgcaacctctgcctcctgggttcaagtgattcttttgcctcagcctcccgagtagctgggattagtaccaccatgcccagctaattttgcatttttagtagagacggggtttcaccatgttggtcgtactggtctcgaactcctcgaactcaaattccatcacctcaggcgatccacctgccttggcctcctaaagtgctgggattacaggcatgagccactgtgcccagcctaagaatgctttcttatttttaaaatcattagcaacttttctattttccattcttcacatgtttccattcctctttctctacctacatttccccaaaatcaggtatggatcattctgtgcctttctccatgttcatataatcacacacacatgcacatacacaaatccatgattctggctttttttcccacaaaaatgaatcctattatatatgctcttattgttgttatcacatataaaatgcctccaaataatctgttgttcacataactatgtaatagtttgttgatcacaccatagttaattcagtcattttttccattgttctccagcttttgccactacaaactattctttaattaaaaactttatccatatatcttttctttctgtcagtaacactcccaagagtgtgattgttggttcaaagagtaagattttcagtttgattttaaaatatattgccagattgatttaaaaggcagtaccttttccaatgtgtaaaaatatactgtatcaccttatagagtgagaaataataacccattgttatttttattagcatttccctagccaaggaatttgagaaggcgttcatgtatttatttaccaaatgggcttgctcatctctaatgaaatttttttttccttattaatttgcaatgcctccttgaagactgggtatcacccctttaactgatatgtgctataaatatttattcctaatttatcatttgcctattgaccttctaatcatataattactcatataaatatttcaattagtttatgtaggaaaattaaatctgtaagttccttggcagctgctggatttctcataatgattaaaaagctatctctaaataagattattcctatgtcctgaatgttttttcagattattttattttttatatttacttatacttacacgtattacctagagaaaggttttttttttttttggatatagaaaagttcacattttctttattctaaattaatggaatgtcttttgtgccagtatataacttttagtaaatcaacaggtctccatatagagaaatatatctcttttattatatattgtctctataaaaatggtatttgtgtctgggctcaatattttgtttcactgctctgtttagccacttttatactgagttttaattaaacaaggtttaattaaacaaggtccttgtttaaaaaacaaggaccatctcaattccaacaggggtttaaactgaactactgtgtgagggaatttgagtaagaccatgggtcatgcaggtaaaaatctaaaacacgaagtttgatggggagtaggagtatttggaggctgagaaaagttaccaaaccccatagtatgtgtgtgtacatatataaaattttagccagtctaaattgtagagaagaaacaggagggaatgaggagcataccagaaatatgacagaatagggaacataccaggcaacacagtgatgaccagagtctgagtccttaaacattttcagtacaaaacgggaagccaatgaaaacttgtgagcagagaatgatatgatctaaaccgtattttaggaagattgatcaggcagaattgcagagtgctggttcttaactaaggatgattttaccacttaggagacatggcaacatacaacatcagcagacattttagttttcacaactggcagaggtgctattaatatctaaagggtagaggccagtgatgctgttaaaaattctgcagttcagaggagactccctctcctgcctcacaacaaaaaattgggaggtccaaaatattagctgtggtgaggctgaaaaatcctgaggtagaggaaggatgtaataaggaccaaatacagaagtcagtataaatgttattacaagtttatgagaagtgaaatgagaacttaaataatataaaagtataaagcaacaacaataacaattttgagaagacagtatctacagaatgtagaatattagggattcatggaaaattcagaaggattaatgaaatataggctttctctctctctctcccccttcctctttctttccttctttcttcctttcctttcctttctttcctttctttcctccttccttccttccttccttccttccttccttccttccttccttccttcctctacttccttccctccctccctccctccttttcttttctttcttttgtctcactcttttatgcaagctggagtccagtggcataaccatagctcatagaatttgagctgtaacctcaaattcctgggctccagcaatcccatatcagccttctgagtagctgagactacaggcataagccactgtatctggtccttaggctattcttcatgaagagtgaatgattaggcataaggatcttctctgttactctacaaggccaatattgctttctttagacactgaattttgtctacacacattgcttgtgtttgcaagggccaagtgaaccataacaaaggaaagtgagcatttaagtagcagattctgaggctggtgttgaaagaattccaagtagaggaatgacatcctaacccctcctccatcatacctacatatcattaaaatcccaggaacaaagggcttgtattagtccattctcaggctgctaataaagatatacctgagactaggtaatttataaaggaaagtggtttaattgactcagttcagcatggccggggatgcctcaggaaacataaccatggcagaaggggaagcaaacacgcctttcttcacagggtggcaggaaagagaaatgccaagcaaaagggaaaaaggtcccttataaaaccatcagatctagtgagaactcactcactatcatgagaacagcagcatggggataactcccccaccatgattcaatcacctcccaccgggttcctctcacagcatgtggggattatgagaactacaattcaagatgagattttggtggggacacagccaaaccatatcagggctcaaggagaaaaaatagattgactgtgataaaacacacacaaaatgttatccttataagcagtatattataaatcaggtacatggttctaaactgttcaaagcaccaattattatgttaaactagtttaatcatgagtactattcttaccatcatttgacaaataatgacactgaagcagagaacctaagcgacttgcccagggttaaaattttgtaagtggaagattcagtgttttcaacccatgcagtctccttctaaggaccacagtattattacattacactgctctcatttttataagcctacaaaagtcataggtttttttgccccacttcgggcatcctgtttgccttattttaatctactaccattgaatgatggcttgaatgggagatttaggctatcatctgagaaagttttgtgaaaatctaggaatgtttgtaatcccattctgccttttttcttgtgttacatggctattcctttttcaccttgtaaagatgactgtattatattttagtgtacattactaatatgatattatatgcgaatgggagactgtatactcaaagtgttttaccatacagtccaaatatacccagtttcatataatctgaatcccacagacaataagcaaataaaatataagggaactgtttcaactgaggtttatcttgttttcattttaggtaacaatgtaccaacaaattgttccttttagattatgtttttgttattaaaagtgttcatttagttaatcacttcacttaggcatcactgaaaataatttttttttttttgaggaaaagatattgagtcaaattaatgggaacatagtaagtacctttgcttattccacctgagaactttctcttagtaataatgcattttgagctttctataggcttgaatgaaaatactttctagtcatcctgtccatattgttactaaatttagggagtcaggatgaagggctatttgcaaaaaaaaaaaaaaaaaaaaaaaaaaaaggaaaaagaaagaaaaaggaatatttattctccagtgtcctagacctcctgacataatatatccaattcaaacttagccactcagtagcctgccatgggaacaaaagctctccagtccactagctttcacatgagctgaaatttatttaatttagggggccaaaactttccattattgaatatcagaattaatttttctttattatttgcaagcaaatacaagtataaacgtgttgaagtaggtaaaatcttaggaaaatctaaaatatggcactcagagactctgaagtgcacaaaccaactgctaaaatattgaagaattaatggataataaagaggtgaaattagaaagccatgagtagagtataaattctttagagctaggctacagaatgttgatcaccatgtctatttttttcctgcagtcattgcataaacatatcatttttatcaattttggaaatgccaatcagatagaaagttgcatttaaaagttcttaaggaaaagaatatagtgtagcataattcatttgcagtcataagaagtataacaggtcatcagtgtcaaaaagagtgtgtttacttgaatacaccataattttattatctgtaaacagttggtctttgaacaatgcaggcgttaaggatgccaaccctgggcatagaatgacttttgacttaattaatcaattaattaattatttcgagacagggtcttgctctcttccctaggctggagtacattggcacaactatagttcactgcagctggaacttctaggctcaagtgaccctcctgcttcaacctcctgagtagctaggactatacacgtgcaccaacatgaccagcttatgtttaaaatttttatagagataaggtcttgctatgttgctgaagctggtttcaaactcctggcttgaagcaatcttcgtggctctgcctcccaaagtgctgggattataggcataagacactttgcccggcgtatttttcttatatttagtgctatgatctgcgtaaaaaacgtttgtacctctgataacaaccttttgccttataagagggtttaaacagtttttaacagtaaaatatagaagtattgcataactaaattactgttgccatgaagagtgatgtctgattattttgagagttcattctcaacttgttccatggtcaattaatcactcaagttctaagtgtactttttcttgcttcaagaatgatgataaaatacaaaatttgcattaaatagacttataaattaaaatttagtgatgcttgatatcacagattttttcttatttttttgatattggtacattattttaaaaataaaaattaaacaaatcaatgcattattttaaatttgacttgttcattcatccaattttttatactaagagttcattggtactatttataaaacaggccccaaatttgacattacttaaatactgtaagtgtgatgtttcaattacaattagcttttcaagtaaatcaaatatttctatggggtacctctttgttaacataaataaatataagcaaacatattttacatatgtttatatataagtattagtgaatatattttatgtgtatgcaagcatatatgcattaatataaagccagcatagaagaaatcagcatacactgaggacttatttactgcaaggtactattataacatcatctcattgctcttcttaacagtgaaacctaacttgatattgttattatggattggaaatgcaaacgttggaaaaattaaataacttgctttagttcacacacttgtaggtgccaaatctggaattcaatcacagatctgtctgaaccacactataaactctcttcattccaaagaccatagccatttatgtcataaccgtttatatgagtaaaattcatgataattatacttttatatgaataaaattcatgataattatacataggattttcaggcattttaagaacataaccataacagagaaattctttaaactatgtttcttctcaaccaccaaaagagagcctctattataccttaaggacatttagagaaaaattatctaaggttttcattagagaaaaacgctgaggtaaaatttcctggagagtgtgaggtcagtgaagatagtttgaccttaaaattgtactttagttttatactttcctattagtcaaaaacttttaatgaattcttctttccacctaaccccaaagcctgggatcaagcaatctatacagttatctgataggaacagtcctctagaagaaaatccttgcccgaggctcagcactccagagtatgaaaggtgcagatggcacagggtgacaggttcaatctgaaacactgagtgatgtgctttcactcaacacctggacaaagtaaaataagtacaatcatgcaccacataatgatgtttcagttaatgatggaccgtacattcagcagtggttctataagaagatgataatggagcagaaaaattcctatctcctagtgatcctgtagctatcataatgtcatagcacaatgcgtcactcatctgcttgtggcaatgtggtgtaaacaaacctactccactaccagtcatataaaagtatagcatatatgattatgtatggtatataatacttgaaaatgataataaacaactatgtcacgagtttatgtatttagtatactacctttttattgttactgtattctttcaacttatacaaaaataaagctacttgtaaaacaacctcaggtatgttcttcaggaggcatcgcagagaggctttttatttttatttttttagacagagtctcactctcgttccacaggctggagtgcagtggcgcgatcttggctcactgcaacctccgcctacctggctcatgtgagtctcctgcctcagcctcccaagtagctgggattacaggcacccaccagcatgcctggctaactttttgtatttttagtagagatggtgttttaccactggtctcgaactcctgacctcaggtgatctacctgcctcagcctcctaaagtgctgagattacaagcgtgagccaccatgcccggcccagaagaggcatttttatcataggagttgacaacattttgcatgctactgctcctgaagacattccagtgggacaaggtgtggtggtagaagacagtgatactgatgatcctgaccctgtgtaagcctaggcttatgtgtgtgcttgtgtcttagtttttaaccaaaagttttaaaagtaaagaaaaaatcaaatagaaaaaaatcatatagaatataagtacagggaaagaaaatatttttatacagttgtacaatgtgcttgtgtcttaagctaagtgttactacaaaaaaagtcaaaaacataaaaataaaaacattataaagtaaaaaagttagaataaactaaggttaatttattattaaagaaaatcttaaaaataaatttagtgtagcctaagtatacagtgtttataaagtctacagtagtgtacagtaatgtcctaggccttcacgttgccttactactccctgactcacccagagcagctttcagtcatgcaagctctattcacgatgtaccatcttttatctttcacactgttatacccttttattttttatactgtatttttattataccttttctatgtttagatacaccaatacttactgtgttaccaatgcctacagtattcagtacagtcaacatgctgtagaggtttgctgcctaggagcaataggccataccatatagcctaggtgtgtagtaggctatatcgtctaggtttgtgtaagtaccatctatgatgttttcacaatgataatattgcctaaggatatacttctcagagtgtttcttcatctttctaatgacaggcatgacattacattgctaagtactattaatgtgcacgtttaaattaattttatgaactttcaccaagcagctttacaatgatcattctcaaattagtagatcatctcttttatggcattcttgaagtgtttaatgctgctattttgaggtttgagcacactggagtgttaaaaactactaacaaagtgaaattaaagtgaaaacaaaaaacgttgtatatatttttgtgctgggctcaagtttctgctctttataaacaaagtagctgcctaatgcattaaagaagcagaagagttaagaatgtctttaatcatatgtgtagtctttgggtgtttatgtcggttatcagatcataaaatttattaaatatgcagttttgtatatggaattcttttaccatatatgagagtaaggcattagattttatttctagataatttgcatatatttcaatttatatgatagatggtacaatgtggaaagaatttggactttttatgataattaaacaagagactatataaaaggctgctatattaacaagctctatataaaagagctaataaataataagctttctgttttccaactgaaagagttttgtaaatgaggggataaatttcttaccgatgtgtgtgttttaatggaaaaatatgttcatagcacgttttgctatgagtaacaattctaacctctttgcaaatacataaatcatgaaaaatttattaaaatctaatgcttagagatgggcataactaaaatatagacaaacttaaactatagagaaaggaaatgtgtatgctgataagcagcttacgtagtaattggttatttatattgaggttaaaaagagctttcccattatctcaaaaatcatgctctcacctttacagattctaaaattccatcttagtaatggtagaatttacccttaacacttaacatgtccacgcaattttgatgacatggtgcaaacatctctgatttttttcttctacctagatttactactgggttggggttcccactaccagacataagaaaggatagtacaataaaataaaatagtggcacattaaatatttttatggtagactgacttttatccatcaattcatagaaagttggaattgtaagggatctgtataacaatttatcctttttataagtacactgaatttcagaatctccatgattataagatcaaaatacataaataaacaaataattaaatatattcagattacccaactttattcaaatctagtatgtaaggaacaatacatcttaaggtcatggaaaacattaagttacttgcccaaggtctgatctggtttgtctaagaattaaaaaacaaaacaaaaacaaaacaaacaaaaaatacaaactcatgtctgatgtgcttgcaagtattattttcattatatttgcataatcataatactgaccatagcacaactaacaatagcagaaacatgagtacagtttgcatagatctcttacaaggaacttaatagacatggtgattatcacaagagccttgtggtagcaagaacagtctttattatcttcatttactgatgtggataaagttcagagtttcattcagtagcctattgggtcatgataggtagcagtatctctctactggatctctaggctgctgattgcagatatagtgcttgcaaatctaattattattgtaatctatttggtaaaatgatgaagatactatgatctgtactgtccaatatttccatagagttatctatttcaggcaaaagtactcttatgagatctgtagctaatcaaattatatagagaaccattctcctatgctaaagttattttaatgaacatttagaacatgaatgacgtcagttaaaactactcccttactttattaaaaaagtatttttaaaagtcatattcttatttacagctaagttataattacataactcagcaacaacgcatgttcctcaactctaaagacatgactttaaattgcaaacaaataaataaagcttcaattacaagtaatgctagaactttgtttattgattatgaagtataacaagataagcctaggaaatcccctgctgtgtaagcctgtgtaaaaaggcagaaagtattaagcacttaaagctatttttagaagcctaattcccaacttaaattcttatcctatgttgtgtattcagtgtgttcttagtatgaaaggcttctgtgtcagttacccatctgagagaacatttagcattgacgtctaaatccacataagctgtatacaagtgtaagttttatcatgtgtagactccttgatctcacagacaacttcacagagaattcaaataccaaatagtatttaagagaggcaaaacacaacttcttagatcaacataatcaagctaaatacccttttactagcactcataaaggttaaatccctagagaatcacttgtctctgataaataaattctccactcacattacatttgagtctctctgtgtgtgtacattggggtgagggcatgaggaagagttggggagagagacagagagagactgagagatacagatttcttttcaaggcccagattattctctctcaggcatatctctcaattcagatgtagactgatttggaaatctgttagcaaacaagcacagagaaaagagtatttgcaacaatctgttttattttccctctctttcttttaacttctgttttttttttttattctacccagttacaagactaaaccaatggtgattcaggcgtaattcctatttctgatgagctcctttcagttatctaaaatcaggaaaaaaatgcatattcaatcatagtattactagtcaaagaaaataaagcgaagcagggcccctttaaaatttagtgcattccacttgaaatcatgctcatgaggatattctagctattttttatggcacagagaagaaaatgaaggttattttacctttaggaaataagtcatttttactgcatttctgaatgataaaaacattaagaaaaaggcaaatgcaatattataatccatttatgagatttctgttttcaggaatggagaagaaatgggcaaaataattaaatagacccagaaatggagcatccctgactccttcagtagaactcttatttgcttcaaatcctaatattacttaatgccaacagttcccacaattctgagtactttgggtatgaagcacaattactggcaatttttgaagggagcacaccacttagtgcaattcctgtagaagagtgaattataatttaatcaagcagaatgccaagtttgccacaaattggcagactaactttaaggaatatatccagacagatcataaaggtgtcttgccttaacctcctccaatgtggagggaaacaacagtatggcttactgacaaagcaagagaataccttaataattatcagcatacatttcttagtcaacagggactgttcaggaaaggaagtaaacattcaaagcttaatgatttctcttgtgcatagcttctgtgactcatgccagattttcctgagctagttctaaaatgatttatctgcttcagtgagtttaaagcatttcatcttcacttttctttgggcactgggaataaaggttaacaaagtcatctgcgtatattgaggtgtgggtatctgtgtatatctaccccaggctggcctagaagaagtgtagcattgtggtctcctttatgtacaagcaaacgtggtagcactgtacctccaggttctatggatagtggagccgggaacagtgtaagtctcaagggagacaactgcaatcacactgcagatgaggtttgggaggatagtacctaattctctgatgacagaaaaaaagacaaagaataacctactcagaaatctctcccatatcttcttctgagaggcttgaaattacctctattaagcttctctctatttacataagaaagtaaaatcaatggcaatgtctctggaaggctgttatttgaatgcgtgtatgttgcatttaagtcagtattcaaatagcctccttccatggcctggaggttgtatagtttgccccagtagggttcaggttgatccccaagaggctggaactgggtgagcacggattgacaaaggatgaagagagcatgaggatcatctcataagaaattattttggggatgaaaagaactgaatagcataaaagttaataaaaatggcagaggttggaccctccaattaaaaggagaacaagttagagtgaatgtatatcaagcacataagatggcatgcagaaagattgctattagttttgaacattcttggcttgcctttgccacctattgaaaatgcagtgtctggttaaaatggggaatgattcaaagggttctttttattctctaatcgattatggtgaagtgacatgctagattagtggtaagtcaccttagaaagttgcctaaggacaaaaaataagatgcgtacaattccatttggggaataaaaagttttacagaaacttagagtaggaaatagctaactcacaagaggttaaatcccagaacatttattattcacaatgaatgtgagatccaagcaaaggaatagagtatcaaagtaagtcaggaataaaaaaataaatattttaatttcagatattttttatgatttacctgaattcaacactgttgagatacagtatcattttgccagaagaggtaaatgtattgatattctttgtaaaccagtcggtgccttgagagaataaataatagcaatacggttattattagtcagcccaacacattgataatgacatagctgactgatgattccaattatacatgccaatttgaggatattcagatttgtttttggttatgtatttttccatagtttgttagctacaccatgcaggagcaaattgcgtaagtaagatgggtgggctgtcaacaaaatttaggttgaaaactttcagaggtagaaatgaaaaaggagaatattcagtattttaaatggcaataaataatcataaggatatgaaggggcaggaaaacttggttaaagtagtgatcttgataacattagccatataggaaaatttttattttagaatgcactatgacatttccaaagacaaatgcaataaggaatcaaggtgttttcaaagacaataatctactgcttggctgaaatattgaaaaaaatagattcataataaattatctttttttaggaaactaaatgatcaacaatatctctatgaatgtacaatacaaaaattaaaggcaatcttaaagcaggattcacatattttgaagctcaacaaattgttgccaaagtgtaagaaaaaacagtaaatacctgaactttgcagcataccctagatattaatcaattagaccatgggaaaaagaacaacagtttcagaaagcaaatctttatggccaattcgccaatattagcctatcataacataaatctgaaggcatcacagggactctgagctaccactcaatagactaagcaggagaaaatcttacatagtcttactattgagtgaactatcacaggtctcactccaataccatcttagttatttgttaatcttgtctccctcctccatgcctcaccttcccaaaaaacaatcaacagactaaaaacaaacctgggttactctcaattatttaggtgaacagagttgaatatcattcatctaaaaaagaggcctctctcttgacttctcatcttatctatatggaggcatttgtctctactcagctttacacaaacatcccaaatctgtgtgtccaaactgaattcatttaacctgagtatgctgctgataaaacatgttttctctgaatccctagatgagtttagtatcacttgattgactccatgctgtactcctcttttctccactgggtgggtccagagcttctagacagaagaacagctgaacagtatctgcttctactgttaccatttaaatactaaatagttatcaggctagcagcctggagagtgcatacttatcaaacaaccaatcaaacatacacaaatgacaattaaaaataatctttcttttgtcccatctctttacaatacacaggttcccattcctgcctagtgcttatctcagggcagtcttatggtatcacttgatttgagactatcttaggccctaggttacttctattattatatatttgccatatgtaaaatgacttggcatccttaataactatgcttgtcttttgtgcatttcttccttgtgacccttaataattctgaggtcagttgtttactttccaaggttttgttaaaaccaaattacacttccgtacactctgtcacaattagatatcatcctgtcatatcttgtaagcagtggttaaatgttaaacttaaccacctgttctttcaccaaccttggactttgattctgcctcttttatttctaggactacataagactttttctaaccatgattttactttgctctgaaattgaaaaatatagcagttatttgttttaatgaaaacaatgttttatcttttattttttcttttctagatcaatacaaattttaaaacaaattttaataatttgccatctcagtttaactccctttcagtccattcttcaaagcatctagttacacgtcaaatcatgccactcccatgcttaaagtttcctcatagcttcaagagtaagttgaacctctcatgagaatcacaaaaacttggtcatgatgtatcccctgcatctctcctgagcaatactgcttaactttcctaagccttataacaaaacctaagattgtactcctgccaccctgagctacttgcagttccccaaacaagccaattcattatttgccatgcttttatataggtagttttctctgactcagtgtgttttctggtctcctttctctttgactggacacttttaacagtgtttcaagatgcagctcattttgtaagtttctcaaagatcgaccttcatcccttcaattcagccttcccagcctggttcagcttcttgtctaaatggccacagcacttgtgcttccatttatcatgtgattgctgtaccgtctgtttatttgtttgccttcaccagtataaccaaagtttcctaagggcatagaccatgtcctaaacatctttgtatccaagacatttagcagagtgattgatatgagtggtatctaggaaaaatattgaactgacttaataacagtatacaaatgtcatcctgtttgataatgtaccttaagttatgttgtaagttaaaaagccagatgtcttcatctgagccacaaaagaaaccagtatctctccttaagattcagggtatttctaactatggttgaaatgtgaactttaaatttaatgaaattaaacagatgcctttagtagtctgatcaactgttctcccaattgatatatgtatagcagatatcataaacaattcagcatatattttaacactaatagaaaacttgaaataatgcaaaatatttcaaatttattaggtattattttaatcatgaatgcattgtcgggggtaagcatcactggctagttttcatacgttcatatatcccactcctcacttgatttactcgagtgaggaatgaaaatgtcccttcacaatgatatatttatgctttcctggactcaaagtgcctagagttaaatttggaaataccactgtagtaatgcaaatattattcttcacatatttttctgaggaaacaaatatggaatgcatatatgatatatacaacctgacaagctacacagcagaaattgcttttggtttccttagatgaagaaaacaaaaacagcactgacattgaaagtaaaaagtgtgttctattactcagatttagaaatgtgactagactagtgaaataagtgcttatagatttggtaagagaaggatgaaggcaaacgcataaatacacagtactatatatatgctattattgtttagccttagatgtttcctaagtatattagaaatgaaagcagaacaactttttcactttcataaacaattaattggataagattgtattcaatatgctcaaattttcattttaaggtagaaaataaaagtggcaaaagttttcccatagaagaataagctacagattttggaaaaataggagacactgaatcttgtctcccctctcccccaacaccttaaaaaaggacaaaggcaacacaaatatttcaaaacttttctgtttttaagtcttagtctttttgcctaatattagaatttcctaggcttcctagaatcattcatgtatggacaaaataacagagaacacatttaaatacactaaagtttgaacctgctttacaaacaaccctgaattagtttgaaattacgtaaaactcaaaattcagtagtaatgagaacattcagatgtggttttctctcagtgcagtgccaggcatgtagtgtgtagccattaaatattagcagattgtttattttcaagagatagctcacggtatctattgaaagttgacattttttttgtctctaggtgtacaaccaattaaacaagtggacactaataaatttccctttcacctactacattaatgtaatgtttctataatattttagtatgttaaaaaaacaaaatcctagcaattattgcagaagccatttttcatcagtattttatactaagctatgttaaggtcagaattaagggtagagtctatagtttgtatttactaagtcctgtagtatttgacctttaaatgctgttttgtcatagctattacagggaaagtgatagtgatatatccagtttcatttctaaaataaatacaaggtcattgcctccagcaggtgactggaaagaatacagtgtgatattcttaattgtgatatccaacataaagctgagaattttttagaccttctgaatgtactcaaaaatataaataaatataacaacaggttatccacagtcagctatgatcaatttaatttagccaagcagacaaaagcagcttccttaaataagagctacccagggtctcattagtgtagagagacaaaaaaaaaaaaaaaaaaaaaaaaaacaaggtcacgctcaaggtgtatgacttcatggtggaaaatttcaatcctccaaatacctcccagaaaagaaaccaaaggctagagaaacaactgtcaggcagatttcaaaatctcatttagaccactgaacaaataaaaagatagaaaaacgtgttaattctaaatatactgatatatatttttacaaagtaaggttgacaaagttgaagttgggcatggaatgtctcttattagaatggcataaagaattcactgcacaagtttgaatctggaaaagtgagtacctaaaataataaagtggcaattttctgagaattaaattttaggaaaaaagtaaacaaaggactacaaattgattttatcaatagatacaaatgcattttcgttatttatcttttaatcttgtcttggcatatttagaatgataaaagaaaaagtgtttataatgtactctgttgaaatgcaagcaaagaaaggtgagaaaacatattcattaaactatatttattcaacaatatatgcaaacataaggataagatacgtttttctacattatacatgcttctatttctccctccttcataaatatgatgaggccaaatcagcattattttttagctcagatgagctctgtgataggctaaaaactatcacctatcacagagctcatctgagctaacaaataatgctgatagcattaatggacttctaatttatttaatattgttttacatgcagcttttaagatcaagcaatctgatcctttctaaaagatattatggtagaataaaggtcacatatttaggctggcaaacccatgaggagaataatagtgcatttcccattagaatctaatgctgataaatcaacgtaactgtcaacagctgagtcctaagattaacacagatgtggaaaaggaaggtaaaatacaattatgaaaatggaagcaaacagtatgcttaaggatgtcagatatctgggaattccttttttgagcagaaaatataaatctataagccagttttcctttagaaagttctaatgcctctctgtaagaatattttattttaatttgaagatttatatataattctatatgtcattaacataatcagatccagaagtatcaccagagcacaaattacacaataaaattgaagtgactatcttcaccacagactgctatgtgatttatagtgatgcatttcaattccacttgcatttgtgcccgctttgtgttagaaatcatcaaagatggagaacttagtttttgccaggtatcttcctggacactttcaggaacttgggatgaactttgggaaagctcagcatgtggtacactatgacactttacaagcttcctatgttgaaaaaacctaaaggactttgagctattatttcatatcttgaaagaactatggcatagcaactaggataggaaagcatcatggaaacactggaacaagttaccaagtaactgcttacccagtaccagcaagtagctaatgagaagcacctcagatgcaaagaaccagcaccctatgagacaggctgataccctcggagtgtgaagaatgagacaaaaagaagcacacaagagtgtgctaattagaaacctaaaggagtactgataaccaggacgccaagcaatccagaatcagaagccctctaagatatttgagtaaataagagagtgtttatattatactaataagacagtgtttctgttacctaagaatgagccattgtactggaaatctctttgtccctccaaatctgttcttcagctaccttttgttcaggaaattgacctgtatggattccaacaacaaactccattaccctctgacctcagttggattaggctaatggagaaccctgaaagaagatcagacagaagaaggaaaatgtgaccagtactggggctcccgctttgaagacagtgagctggctgtgtttcctgttgaaggtcactactcctgtcaatgcagtcctgtctacattactttcttttctgggttttagcattggtaacatttctgttactactattcctggggtccctgatctcctctttagtccccaacattccacccacaacttggtaaacagtcttctttttaaaacttccttcaactttgtaacttaagagtgacatctgttctctgttgggaccctgcctgtgtagcatataggtagaaaggggagaatgcacatgggaaaacggaaagaaaactcacatgagagtcaagaaacattggctcaacatctatcactaataaatctatgcactgaagaaagccatttatcttctctaggcatctttttatttttaaagagcaaatttgcgaagggatctgaagtttctttttgcctttaaaaatttatatttctatgactctaaatatagaaaacatgattataagacagttggtatctgtttttttacatccttcttgcatcctgtggcacactactgattgctttatcaatattcatccttattctgctacagaaccccccaaaatttggggtggcaacatgcccagcttaataaaacatatgatttatacattttggaagaatagggcagccaagtgatttagtattggctaatgaggtaaaagtcaaagttactggatggggcctctggaaacatgtaaggctgtctcaggggaatgtgtgctttttctgccctctgtccttcctattctttcctgaaatttgggtgtaatagttagggtggggaggtcttccggagagtgatcgtggcaggctggtgcgacaacatgtggaagtggcatgccagccttgggtggtctttcaacttatttcctgagagagcttacataatgacgtttttggtgtttctccaacataaagtctttttttatttctctaactcaaagtagaacataatcactgttatacacacacacacaaacacacacacaccatttactcctcgaaacactcagatcaggactctgtacttaaatgtcacaataaagtctacttcccatttttagtcatataagcaatccagtgcctcaaagtttaccagcactgtgctgaaaaccaggtaaggctctaattcccaaagtgacagctaacttgtctaatccatgtggtttccttatcctaaaacttaccagtttcacttacagttagatacccaagagaaactcctgcacaattacacttgttaagaagaatgttcacagcggcatggcttttctttctttcttcctttctttcctttccttccttctctctttctctctttcttctttcttttttttttgacagagtcttgctctgtcgcccaggctggagtgcagtggtgcgatctcagctcaatgcaagctctgcctcctgggttcacaccattctcctgcctcagcttcctgagtagctgggactacaggcgccagccaccaagcccgtctaattttttgtatttttagtagagactgggtttcactgtgttagccaggatggtctcgatctcctgatctcgtgatccacccgcctgggcctcccaaagtgctgggattacaggcgtgagccaccacgcccggccagcagcatggtttttaacaacaaaaaaactagagattgtatacagatgccatgggatatcatactgcattgaaaatgagtcaactacagcaataagcaactatatggattaatatgtcaacaaaataatgagtgaaggaagcaaaccttgtaagataaaggaacagcttattaacctttacataaagttaaaacaaaacaaaaaaaaaccaagaaacagaaaccaacagtatattccaaaaaatatattggtttgatttaatatatattttaaatctattttttaaagtaaaggaactgaaatatacagatttcaatgttgaatgctatcttaaccagtttgggttactcgaataaaatacaatggactgatgtcttaaacaacaaacattaatttatcacagttctgaaagtgggaagtccaaaagtgtcagtatggtggaattcttgctcaggtttgtcatcctgactatgtcctcatgtagcatttccttggtgcttgcacacatagaaagattttctcccctactttttataaaggcactaatcccattcatggggtacaggacacactaccccaaaatatggcaccttgaaaactgagaaaacagcaaaagcaggaaggtcactctctgatcttttcccactttctgtgtgagagctagacataacagaattttctgacctatcttccctgaaatatatataaccctcacatataacaagtgccctgcccatgtgtggaagaaaggaataaaaacacagagatgacaacaagaatctgaacaaacaggccttgctaagtttcccccagtttattgccattagatcatgttgccttttgtccaatcatacttctacatgactgtctactcttcatcaaacctaagcataaaaatacaggtatgcggttttccctgtttctgtgggtcttcctttccaaaggctcttgtgccacataaaactttgtttaaataaatttgtaatatttttctcttgttaatatttcttttgttgtagaggtgtcagctacgaatcttgccgtgggtgaggaaaagatactacttttctctcccctatgatgtcattggagcctctaccctcataactcacttaaacctaatcacccctcaagggccaaacctccaaaaaccattgctttgaagattaggacttcaacatatgaattttggaaagacacaaacatttagtccataaaaatgtcaactttctaacactattattaaataattataaccataaatttgtgcatgtagacagacaaatatttggcttagggcccacttttctaaactaatcaaaccatttcagaaaaccttccagaatcagcaatagtttttttattcaccataatacatcagtttaaaaaatatatatatcacttaactctcccaccccttttatatttctgcaactcacaaagtcatatatgagagctaaaaattaaaatgatcaacctcatgaaaatgagagtaaaatgatggttactagagactgagaagggtagtagggagtgggggattaggtgagggtggttaatgggtgcaatgacatatttagatagaacgaataagatcttgtatttgcctgcacaacaaggtgactacagtcaataatcatttattattatttagttattaaaaataactaaaagctttgagtacaattggaatgttcctaacacaaagataaatgcatgaggtgatggatattccaattaccctgatatgattattacatattctattcctatatcaaaacttcacatgtaccccataaatacatgcacctactatgtacccataaaattttaaaaattaaaaaaatacttattgttaccttctagcttattttacattactgaggtgttaatgggataaaacatgaagctcaagaagcagaatagagatggattactgcatgtggcttaagagtaagagacacaaaaatctcctaaatccatctcctttggtctagcattcaaggtgccacacaatcaggctccagcctcttttcctacctttctaacttactctatttcaatcacccttcacaaagcctccactgtagtcaatctcctaactccccaacaacacttagactttcctgcatcagtgtttctcctaaggactatttttgttcactacattctacatgtctggaaaactgtcttctctgtctacatatttcaatcatatccattcttgaatatccagctcgtattttttcttcttctttgaaactattttcttagacttgctatacaaattctcatttgtaaaaagcttatttgttagccaatctgtacagcatcatctgctctcaactcacttgtttactatcatattaggacttctcgcagtgcctacctagaatgggatagaggttcaataaagagtttccaaacatctaaactccaaaatatcttcaactactctcttgaaattttctttaaattgcatatttttatttttctattgtcttcctacctaaacctctttgagagaaagaactatgcttattgtatacttttcctgatcttgctaaattcattgcttaaagtgctccataaaaattgatgtttgcctttaaaagaataaaaacattaaagcagttgggcacggtggctcatgcctgtaatcccagcactttgggaggccgaggagggcggatcacgaggtcaggaaatcgagaccatcctggctaacatggtgaaaccccatctctactaaaaatccaaaaaaaaaaaaaaaaaaaaaaaattagccaggcttggtggcgggcacctgtagtcccagctactcaggaggctgaggcaggagaatggcgtgaacccgggagttggagcttgccttgggcagagatcgcaccactgcattccagcctgggtgatagagctagactccgcctcaaacaaacaaacaaacaaaaaacaaaaacaaaaaaaataaaaacaacaacaactaaaattaaagctgtgcctaagaatcgtgtcaacatattaatttcctctcttttaaaaacacaccatgaaatcaagtcctaataatttctgcagaaaataagaagattaaatttattttttgagtcaggttacatatggttcagaatcacaacacaggagagaaaaaaattcttcataatcaaatttgccaaaatgttccaaaatctggggaaacagtattactttcactaataagatgccatgaaatgcaatataaaatcacaaatattattaaattatttcataaactacatttggagatttttaaaaataactttagcactttcctattatatatatttttgctgtttattactgacaatgttgaaaatgtatctagaatacagagttgcagtcttagtattttagttctccattaatgaataagattagattaaataaacaatgcgatagaaaaataacgtttactgctgttgtctatcctggaaagcacattcatttctctcatactgtgtatatacatgcatatacatatacacatgtagtttatatattacacataggaaattatccatatcatcactaattataatagatgttttcaatcaaggggtcatttcttatcaatctcattaacggtccatagtttgggtgtttgtcatttgaatataattaaaccggagaaaatggcatcgatgttttattacaattacctagaatataatgcctggcacactgtaactgacagcaagggataagtggtggtttgtactttttcttgccaaacttttaaactagtccctattgccgggcataatataaaatcaacagcataagttaactgcagtggtatatgcccacacttaacagcttctgccttcttaccctgtgcatcactcaattaagtacttaacacagtttatatgcacataattataattaactccatctgtgtggcatttcacttaataccaagaaattcatttatttgatcatttgataaactcaaaaatcattcattaaatcctttgacattaattacaaaagtgcataaaataactctaggataattcttgttaacatattagtaatcacatcaagatgtcaaataatactttcaagtagaactgggtaagttagtgattttagctgagaagatggcagaagaaatttcatatgaggatggtagtgatcgaaagagagggcaggagaaataaagatttagaggagaaaataatctaattcccagtaaattagaacaaagaaacaactactttgtaaaggactaagtaatgaagtagtttgagccatttgaggaagagctttgaattaattctatgctacacattttaaaatgaattagagatttagaaaagaatcattggaattcaaggatagaaatgtattgtgattttattcattgattaagagattttaccgacagaagagtgtgatacggaatcaagtcaggagagaagggaggctggcagattaactaagggatttcgtttgtaacctaaatatgaaataatacttgaaaaagacagatgcttgggaatgacaaaagatagaacacataaaaagcatataacaaactagaacttgatgtgaaagcaaaaatgagctgattaatggtgttgttgtaattctgtgggaatgagaagataggtactaggtatatatgttcctgagccaggataaacaagattcttctatgccgcctctcctctcttaaagtagggtttcatctttctctgtagttaattccatttaactgtttgaataggcaaaaattgttgaaatcaagtatgatgaatctcatgcatgtgattcttacgttgcaatatttacatgtatggtgaatacctttttgttctgtccattttagggctcacttatttggaaacctccaaacaaatggattatggagctaatgtgaatggttagtcatggaaatctctctcttttcttcatgggagcaagaacttaaacaaacaggatatgtccctgatatggtttggttctgtgtctccacccaaatctcaccttgaattgtaatagtccccacatgtcatgggagggacctggtggaggtaattgaatcgtggttgtgagttttacctgtgctgttctcatgatcgtgaataagtctcatgagatctgatggttttacaaaggggagtttccctgcacatactttctcttgcctgctggcatgtaagacataactttgctctttcttccccttctgccatgattgtgaggcctcctcagctgtgtggaactgtgagttcgttaaacctctttcctttataaattacccagtctcaggtatgtgtttattagcagcatgagaacgaactaatacagtccctgagaagaattcagaagcactcaagtctgctcttcatatgaaatctgagaatgtgtgtttatgtatttaactgtactaaaaataaaaaaccttacatttcttctccaattgcctgctaaactaaaggaaaaattttaaactatagtgtagacaaaagtaattatgtaatctgaatttgtaataaaatttagcagtttctatgtcacatgaaaggtatactcaacagtcttgcaatgttttatactatatggctataattataataaatatacatattcattatattataatatgaattttaattcataatacatacctataatatgacacacatattcgagtagtcttgccgtgcttcaaatgagataaggttaaattctttttgcataccagcattttctatgagttgactcctacacagcatgttgacattggtcagctgtatttttcttaaaatgttttcttcttaaggtgcttcttacaagctgcttgtttctaagataccaagataccaagggctgaatacatcacaattttctacctttaaatgtcaaaagcaaaacagaaaaaaaaaatacaaaagaactagtggctgttcccagaatgtagtacactggcttatcttgtttattttttatgacaagtggtaccaaatccaggttttagtttttaggttttagttctatttttatagttaacattaagtcttataactgttctgctaataaaaaatctttgcctctttctaaaatatctgaatatttatgttttctccaaaatctgttcaatctctcttcctatactattcctaggtatcctacaaattaacttgcaaagcagtcaggtgttttgttagatgtgaccaaaatctagatttttgacaacataatttttggggaaaagttataattacattgatcaataattagtgttggtaaaatgtaatattcctaagatatagatacatatatcaaatgtttggttgcactaaattgcttttatttgttcttgtgcttgttgactatagttattgataacatttttacattaaaacaaagtataaaatgtttttatgtcatgtagcataagagtattacaagagagtattcaggtccttgctcaacttggctctgaaaacagatcctgctttgctatgattgtatgaagatagttttttcattatgctccattttcaaaattttagagcattatctgaaggagaactttatatcctcagcctgtgaaatctgtagtatggtggaaagagggtgtattgtagagttagatggttcttaagtaaaattcttacttggttttttacttgctgtttttcattgttcaagccacttaatatctatgaacctgtattcacttctattctttatctatggataaaactcatagaaacattaaaagaattaaataagataatgaatgcaaagcacctggcatatgatagatgcaacatttgtaaatactttgaaaaaaacagaactactactcctagtctcactatgaaacaattgatatattgtacaatttgatttttagagatgattttggtcagtttcaaattttcttctaggagttcagttctcctgttaatgttaatgagtttattttatttagaattttgatgatcaatgtcaagtttctcttgggtccttactttcccttcttctttatcattaacttgcttttcaactatcttattgctaacttgaagaaatttagaatcattcatttaaaaaaaattcatgtcactctaattcactgtgtactcataaatttgtaaaaatgaattacattagcaaattttgtatttaagtatttaatagctaatttatatacacatttaatttttaactttgttttactagcaataaaggcaactgcacatttttatattaaacatttagtatgatttgaactgatttaatatctttcatttattattaaattaatgcattgttatcaccctgcagcatttggaaaccaaatttgggcttgaaataatatagcaaaaagatagaaaggctggaatgagtaacagtccactgaaatgacagaaaaagctgaaatagcaaggaaaggataggaaagattaaaaagctaaataaaatattaatgtactatatatattatacacaatataatgtttcatatgtaatcggaaaagtgcataaggaagtcaataaaggcttgagagaaaaaatggaaacaatattctgtacccaactggaaaatacctagtacaaaataatagtaatgttagccaggaacttgacaaattattttgaataaagtattctaagggctttgaatgcattgtcatttagccctcaaaataacctttagaggtttgaattattattatctttataggtgatggaactgatgctcaaagaagttaatgtgcactctgagaatcacagaatttataagaaatgatggcaatgacaatctcaagattttgtctcaatagccacctcttctagttatacattattgtaaaagaaaccagcccaaaagttagtggattaaaataacaatcatttacttttcccaggaatgtgaaatttgggcagggctcagcaagaatggctcttctctgatctgttcagctttatatgggggcttctcaaccggggctagataatccacttccaatatatatcccttactcacatagctgacaagttagtgctggctgtgtattaaaacctcagctggggctaatggctggggagggagagctcatctcttttgagaggggtgaatgtgaggacacgagttgcatgacagataagaaaaaaaaaggtgcaatcaattaattgatttaatttcccagtgggctgtaaacatttctggaattgagaaaatagagggaataaactggaaagctatgaactcatggccagaaagcagaatgtttgagattttggaaggaatattgaattggtaatgaaagtgtctgggcaaagagcttaagagtgagtggctgtggtaggctggcagataggtcatcgaaggaggtgaaagagtcatctatttggatactgaaatccagaagaaaaatagcagaagtagtagtggacacactgacagtgagcctggagatgagaccttcaaacaacataggaaagtaattttcatggggcataggggagaagtggtggggatagactataatatggagtggtagttaacagtacagtaatgatatcaaagatggatttttttttttaagaaaggcaagataatgttccgtaagcagtaatataaataagaattgagctattataagtacaaagactctaggcataaagaaatacaaacacaaaacaaaaatcttccaatatattatttcttataaatccctggataataaaattaatataaaagaataaaactccaacattcatcaaattatctgtcttacaattaggcagatcctaattacagaaagaataggtaacactgacatgactaaaaatgtgacttagccacagcaatttgctgagttgatctcaaaagtggtaagaccatgttatagtcgatgattcttaacttttattttatggttcaggggtacatgtgtaggtttgttatataggtaaactgtgtgtcttaggggtttggtgtacagattattttgtcatccaggtaatcagcataataacagataggtagtttttttttttttattctctcccttctcccaccctccaccctcaagtctgccccagtgtttgctgctcccctctttgtgtccatgtgttcttattgtttagttcccacttataagcgagaatatgtggtattattctttctcttcctacattagttaacttaggataatgccttgggctccatgttgctgcaaagaacatgatattgttcttttttatggatgtgtagtatcccatggtgtttatataccacattttttaaaatttactccatcatcgggcgcttgtagtcccagctactcaggaggctgaggcaggagaatggcgtgaacatgggaggtggagcttgcagtgagctgaggtcgcaccactggactccagcctgggcgacagagcgagactctgcctcaaaaaaaagaaaaattactccactattcatgggcatttaggctgattccatgtctttgctattgtgaatagtgctgcaatgaatatatgtgccatgtgtctttatgatacaatgatttatattcctttgggtatatacccaatattaggattcctgggtcaaattataatcttgttttaagttctttgaggaattgctacactgctttccacaatggttgaactaaactcccagcagcagtgtataagcattctcttttctctgtaactttaccagcatctgttattttttggctttttactagtagccattctgaatcgtgtgaaatggcatctcatttgtggttttgatttgcatttctctaatgattagtaatgttgaatactttttcatatgcacttgttggctgcatgtatgtcttcttttgaaaagtgtctcttcatgtcctttgccctctttttaatggggttgtttttttgcttgtaaatttaatttattcatagattttggatattagactttgatgcatagtttgtaaatattttatcacattctctatgctgtctgtttactctgttgataggttcttttgctgtgcagaaactcttgagcttaattaggtttccgttctcaatttttgcttttgttgcaattgcttttggcatctttatcatgaaatatttgctggttcctatgtccagaatggtatttcctaggttatcttccagggtctttacagttttaggttctatatttaagtcattaatccatcatgagttgatttttgtgtatggtatagggaacggatccagtttcaatcttttgcacatggctaaccaattatccccaaaccatttattgactagggagtcctttctccgttgcttgtttttgtcaactttgtcaaagataagatgattataggtgtgtagcattatttctgggctctctattctgctctattggtctatgtacctttttttgtagcgccaccatactgttttggttactgtaggcttgtaacacagtttgaggtcggataacatgatgcctccagctttgctctttttgcttaggattgccttggctatttaggctcttttttgatttcatatgaattttaaaatagcttttttctaattctatgagaatgtcattggtagtttcatacaaatagcattgaatctgcaaattgttttaggcagcatgaccattttaacgatattgattttttcctatccatgagcgtataatgtttttccatttgtcgctgtcatctctgatttctttgagcagtgtctggcagttcttattgcaatttttcacctccctagtttgctgtattcctaggtattttattctttttgtgactactttgaatggcattgctttcctgatttggctctcagcttgaatgttgttggtgtataggaatgatattaatttttgtacactgattttgtatcctgaaactttgctgaagttgtttatcagatcaaggagctttttggtagagtctatggggttctctaggtatagaatcattttctctgcaaagggatagtttgacttcatctcttcccatttggatgctttttctttccttctctagtctgattgctctagtacttctagtactagattgctctaggactagattgcttctagtactagattgctctaggacttctagtactatgttgaatatgagtggtgagagagggcatccttgttttgtgccagttttcattgggaatactttcagcttttgcccattcagtatgatgttggttataggtttgtcatagatggctcctactattttgaagtatttccttcatggcctagtgtgttgagggcttttcatatgaagagatgttgaattttatcaaaagccttttctgcatatattgagataatcacgtggttcttgtttttagttctatttatgtgatggtgtgttagtctgttctcatgttgctaataaagacatatctgagactgggtaatttataaagaaaaagaggtttaatagactcgcagtttcacatggctagggaggcaaacgaggtgtttgcctcatggtggaaggcagacaaggagcaaagtcacaatttatgtcttacatggaggcaggcaagagagtgtgtgcaggggaactcccctttataaaaccatcatatctcatgagacttacgcagtatcatgagaacagcacatggaaagacccccatgaccgcaattacctcccaccaggtccctcccatgacacatgggaattatgagagctataattcaagatgaaatttgagtggggatatagccaaatcatatcagatggacacgtttgttgatttgagtacgctgaactaccttgcaacccaggaataaagcctactttatcatgatgtatttgctttttgatgtgctgctggattcagtttgctagtattttgttgaaaactttttgtatctctgttcatcaaaaatattagcctgaagtttatgttgttattattattgtgtggagattttgatttaaagtctgtttcatcggaaattataatagcaatgtctgctttttttctgtttgctgtttgcttggcagatttttctacatccttttactttgagtctctgggtatcgctgcacacgagatgggtctcctgaagacagtataccattgggttttgcttctttatccaacttggcactctgtgccttttaatttgggcatttagcctatttacattcaaagttagtattgatatatgcagatacattcctgtcatcatattcttgtttataggcactaaagcacagctgctgatgtatttttctcttccttcttcctcttctgtcattagcctggcaaaatatgcaatttttatgtgttttgttgaaggttcaaatgcctgagaaatgcaccatttcaaactagataattttatttcctgaggagaagcaaaagtgaaaaaaatgcctttcctttctacattgtgccagcaagacttagcacatgcctaatgtatagtaggtgctcaatcaatatctgttgaatgacaattcaaattggcaaaatatcacatggtgtgggaggataggatataaaaatagttggtttatccttaaacttaactaatgtgatttaaggaggagattaatccatgcatggtatattagttaagcaaatggagtggtgtcccagtgtcagagaaatactgaggttaattcctcactcccccaaaggtgtattcagcacaggtgatttaatagctcaaagattgcttttcacttctcctctagggagagtacaataaaatgaattttaagttgcttctgaagaatttatagacttaatatctgagtcttctgatgcaacctattttctctcttttactgggaaagtggtataatatgcatttttataaacttgtacaagatgatgggttcctaattattggtaatacccttggagacacacttgtggtctgtcctttaggacatctgcaccagcactgtttcaatccaaaaggtttacacagctctgaaatggacatccgcaggcagccttctgaagtgaaacaaagactatttgcatgttagacaaagcttattcagtaggaatcaagatggatggtggaactaaagaacactaagatacatactagaacgtagaaattaaagtagatacaagaacgtggaggaggaacagttgacattttttagaataaattaaatgagagttaaaatcatcactatgcaaagctgcagattgagaaggcatttggccaatgtctgaacaatgacaaagagtatgggtgatttgaaaattgctaattttgtcaaattttggcacatagaggattatattggtaatagctaatattttgagtgttgactatatgccagatatgctaagcattttatagagagttttataagtcttacaacaatgcaaggagtatggcatcattgggtcttttaaaacttttaaagaaaaaatagagaataatcaaagtgaagttctattttcataacatatatatctatattataaaagaattatagtcctgatcatccaaaagagccaatagatatttaaagaatattgtagtcatagatcatctttattttttttaaaaaatgtcacttgctatattgtctttatgttaagactaattgaagagggcacaaagtcaaagctaattaacaacatccaatatgtcagtataagaatactgttatttatatttttgtcaaaaagaaaacatctaactaatttaaggtatattttacagtacagttttacaaagcatatcatcaaatgactaatttatatacttatcatcaaatcactaatttatatatttaaaaagtaaatttatttgtgcaggaaaatcaaatagttccccaatgtattgatacgatgactgaagcttgcatgttatcatggtattttattcttctgatatatctcttgcagaacagaattagtaaataaaatgcatatttcactttaaaatttttaaaaagttgattatttttctaacttcctctgaaacatcagtcattccaatattcaattaaatttttggttaagatagcctgtaaaatcaatatgaaatacattttgctgtttggtaactaggttctagacaattagaaaactatatcaataagataatatcatattttttattttagaaaaggctcaggcaactgttagaccttattaatgacaatgactcaatgtaatgaaaacaaatcacagagatctgctagatttacaagaatacacttgccatacataacactttatgagatggggtgtgggtttaatatcaataaagagaagaagaaaagatattaaatgagactttgataagctggaatctactaatcaaaattctcaatgacattttcttctaacgttctttaaagaagaatcaattcccgcaaatataccaaaaaaagatactagagataaactcacaaaaacaccacaaaattagtaattatgacagaactattctcctatagaacatttcagggggaaaatcctacaacaaatgatacatgaacaagtgtccaagagtgtgcttttcacagtggggtctgttctatagacccccgccaataaaattccattatttcagcattttatctggacttcttgaattattgaattattccatgcatgctgaaaaaaataattgaagcttcagttttctctatatttacaaacatttaactgacatacatataaatacatgactataagaatgtatagacagcacttgtgtgcaatctgctgtatggcttctgtgaatgtcactggagaagactccttatggcacagatttattcattcccacagtttttatttcattttggcagaagattactcagagttttagggtttgtccaatcagcttttaactaagcccagcatacaatgccaataatgaattccctacctaaacccaactaactatgtgaatgctccagatgttcttagctcaaacatctgttgcttaaggcaggggggaggttctgcattgtaccatacctgagttacttgctacatttacatacttcatatgggaggctaattcaatccactgaattttaatataggtcactgtacagaggtcaccaatcatgatagaataataaaatagtgataatttaatgataaaccagtaaaatgaagtaattatgaactaagaagaactccaaaagaaaatcactttactcaatctcagtttgctatggcaagtagtatatatattttattaaatgttttctactgaataattacaatattataaatacaatagtcataccatggtcccagtaacactgacaaggcctttgaaggacttggagagataaagtctgggctccaggaccacacccgtactttgggccagatcatctaggcttctattcacatagtcagttatttatttgacatattgttctgcactttttgttggaataaagaattccaaggctaactacatatagcctagctccctcattttacagatgagcaaaaagagaccagagaaaataagtccgatcaaccagattaaataatacagtaaatgaaaacttggattagaatctagttttcctaattatctagtactctatgccctgcacaatactccctcctttatgtcaaaacatccctactataaacccatgtgtatatggcaaatccaaattggtggcaagtcagtatcagattcgtttcaaaagaaatgcatgcagttttattgttcagttagctagcagttgggaattacatcagcaaacatatgcttaaatgtacacaatagggtactaatttaatacatataataattttagaaagaatgaatgaatcgggtatgatcaagccacataagagaatcagttccattgtatcatagccatcaacataaataaatgtaaatttcttgtcaatgtgattataaaacacaaactctgaaaatgtttttagttaatatatttcaatttcttttttacaaaccaaggcttttacattttctcagtaatattttctttatagataatgaaaggcaaatttcattctggttcttgccaaataaccgctaattataaatgtatagtatttgaataaagtgattttattatttccaagaatacctttttctagtctcatccattcacattcatggtatgcacacaacaaatttgtcacattatgctgttagctgaggtcacaactttaaactctgagactactaaggtgaataaacattttcataaagagtgtgacatttgagtcactggagtcagtgaagaagagaaatggcttggaagcttccttggctatgctgacaaaaaatacaagatacaatgccaggtgcaacaattatctattgctgtataacaagttaccctgaaacttagcagtttaaaagaatactttattatttcttacactttctgataatcaggaatcaaggagattagctgggtccttctggcccaggatctcttctgacagagtcagtacagaagtcagataggaatgcttcatctgaagggctggaggatccactttcagcttttcatgtgtgtattggcaggaggcttcagtggctctgcattgggcagctcatacataacagcaggcccctcccagaacaagtgatccaagaaagaacccaagatagaaggtgacctaatctcataagtgacatatcataacttctaacatattttattggtaacacaggccaaccttggcactatgtaagagggaatttattagggttagaatactacaaagtagtaccattgggagatgtctaccacaccaaatgaaaaagcaacatgttaacacatccaattttgatcatctacaagatatgccaagctggagttaaactgatagaagattgaaagtagagtcccatgtgttgatacagaatggctaagatgttaaagagctcttgaggtagggaattaaaaacacatatgacactttgggaggccgaggagggcggatcaccaggtcaggagatcgagaccatactggctaatacggtgaaaccccgtctctactaaaaatataaaaaattagcgggcgtggtgtcaggtgcctgtagtcccagctacttggggggctgaggtaggagaatggcgtgaacctgggaggtggagcttgcagtgagccgaatcgcgctactgcactccagcctgggccacagagcgagactccgtctcaaaaaaaaaaaaacaaaacaaacaaaaaaagaaaaacaaacaacaacaacaaaaacaacaaaacacctgagttaaattgcagctctactatttacagtgagtgatattaactactcagaactccagtttctttatcataaaattggaatcagttatgtatactttggagttagtaaaaattaaatgagatgatgtacacgtcaggtttcttaacatatagtaagcacaattattaaagtaaaggaacaagtagaaaaaggaatatactctttaatttggtctacaatagtgactaatatgtttctactagccctagctatagaaagagtatggatttaaattatgtctcttttcataacaacccctgtgactataattatggacagctataaattgcctaataagataggaatacccttagactcaacaaatctttcttttgtcaaaagaaaatttataaatcttatagaactcaaaaatatattccaagggatgatctgtatgcattctcactcgtgattatatttttaataagcactatttcaatttaataatatgattatcttgtttattttcaagtaccaatagcccattaaaatttcactggaaggtcactaagaaatattttccttatgaattttagtgtaagtttctctctttcagagaagtgataagtaagcttaatataatggctcccaaaatctctctcaaatacaattccatatacatattagagtggctgtagagcacatatgatgaaaacaaatttcacattaaaaaaataatattattggggatatgtaatgggccaaatgataccttaaccttcaaattaaatgtatagagttatttaatattttctagtaagtttttatcttttagcaaaagagaaaaatgaagtgtaatgaatgatgggttaaaacggcaaagactgtaaattaatgttatttttgagaaaaattgtcaaattcaaatctccctttttatttaaacagagttctgtttttatttccatgaagttattccaactgcgctgtatcatgatgtaagtagagtgatacagtgcaaatggttcagagacactgaagattccctccagaattaagaaatgatggccagctaaccaacaggatattatttttataattgtagtagcagcattttaaaatagctagctaatgattttatgtgatataaatgctagttcacagacgaagacaaacttcctggaacagatgatattgaaggagactggcaggaaggtacgaagaaacataaaacactaacatttgataaaatattatatagaatagtacataatatacattatattagtcatattgtatgtaattataaaaatataacaaaaatatattattaaatatcatatataatatataatgataatattatataatgtattatatagtatcatataatgtaatgtactattattatataacatatatagataaaggatcaacctcaatttggagtaaaagttgagaattttttcaaataataaagatagaaacttagatcaaaaagttcaagcatcactaaaggtccaagactgtcagaaaccaaacatttgttttagtttatcttcactgattactatacttgaggaaatcaagtttaccttcaattagtccttatataggaacaaattcaattagaatgtagaactcccagggtaagataataatgcctacaacactgcctggcaaagaacagtcaagaaatatttgttgactgacagaatgaaagagtgaataatttcccccctagaataacattatgtctgcttaatacttatatttaaattatattcatagctgcttcttccttcataaccaagaaactcatgcccctcttgtgactacccactaatactcagaaatatgacacacattttcaaataagtctgatatacttaggtaggccactgtgttcttgctctcccccagggtgaagtgagctgctgttttccttgctaaccctgactagttcacatcaaactccctgtgctgctgcgtgttgctctgttttgtctacctcaagcatttattgctcactgccaactgctgtgttgttctgcccaaaccacttacttgttgtgtactgacttaaacatttgctcacaggcactttagttcctggtgctgtagctattctgtaaaatagcaaaatagcactctcttctgtcttcaaccctggtagaaactatcacaacataggaaactcagcctcatttagcttttcactttaccaagaacagaaccccaaatctttctatggtttacaagacccattgggatttggctggctcctacacatcttctaacattatttttgttcttctctctcactccactccagccacaccagccaatattgcacttgctgtttcttccttctggattattctttttccagatattagcataacttcttccttcatttccttgagttttctgattaaatgtcatctttttggggatggcatataggaactattctatttttgaaagatctgcttgacccaggttacagtattctgtttccttgctttaaattttgtaacatagtttgtgctgcttgacatattttatagctgtttaatttgtttatgttctatttttttctgagaaaaacagacaactatgaggaaaagactttgttttattatcaatatatttgccattagatcaaagcatataagaatagctactcgagacagaaaacatgaaaggaagaaatgaaggagggagggaagcaaagaaggagcgagagaaggaaggaaggaaagaaggaaggaagggagggagggagggagggaagatatataaatagattgatactatttaatacatcctaatctcaagaaaacaagtggaggcaaattgatcctgtggtatgggaaggggtgttataccttgcacatgcaatactctaccaaatctttttcagtccagcctggacaccatatacttaaaactgaacaacaactcttgtgatacgattaatatgcttgaaatatttttattttatcactgacatgtggattaagaaattaaaataattaagaaaaatcttctttaaatgaaatatttggaatagaaagctagaatctcaggttccccgagtctggtaactgtttattatggctatggatgcagtaaagctctagctcttgatttattaattaatggagtgctcaatatatgtttctcaacaataggtaacatgagaattgaagaagacaggagacattaactttaagaaaacccttaatgctcaacaaattctgcaaggttaatgtatgctgttttacaggaatatcacaactaaaatattttaatattattttttcccttgcaacaataaagaattctcatgcaaagtctttatttaacttgtctgttgtttgtctgttgtgtccttttaactttatttatgtattttatctaggcttgatctgtcagacataagctgtttgataatttatcatattattattgaagcaagttgtcaaaccagttaaattcatgtgaaaaggaattcaaattagggcaacaaatcttcaaagtccagctgaactgctaaagtagacaaattccttttcttctgttttccccagatgctttttacattcactgatttttcttcccttttgtaaatggaggagaaaggaagaattctgttaaggcaggagtctgagacaagataccaacatatctagaggcaaagccagcatttctgttctcaaccataagaacatacgaaattatgtttgattaatttcaggaggtggaaactgagggcctgctggctctaaatctggcttgctgaagctttttcctttggaacacattgttttttaaaagcaataattatataaaatgatatataagtatatatattaaataatataaaacgtgcatatgcatatctatttgtacatatagatgcatctataggtatgtgtatatatatgtaaggtagttaccatatataaaatataatggcatttacaataaaaaacatctgaatattcagctgttcttgatgactctaggtatcattaggcatacatttccacatgataatcattagataaaactgagaagtaggcacattccttggacagagtatgctttaccaattcaccaaagtcatgggctgccttttatcttacatttggtctaattcatacatctatattatgagaatggcttctgtaggcatgtcagtttgctatcaatttttaatcagtttgattaggctagagaatatttgggtaacagcttttggttgaattggtagttttcttcaagagctagtttaacttgatagccccaatttgtcatgtacctaactttttctatatccagtacaatttatatattaaatagcatttttagagaattaagttttcttgttatgcttgacacatagttacaggggaattttgccttcgaaagttggtgtaagatttttctttcccatcatgttaaatgaaacatgatagacaatattaaattgttttttgataaccaggagtttttagataaccataatatattcaattgtagtatgctacgaagaggcatatacagggcactggattggactgaacctgcattaattccatagccaagaattattttggctaacataaattttagaataactatcaggtactttctccatttttcttgctatttgaacttttgtacatcaaattttaggaaagtaaatgaaaaaatacattatctaaaggttttgattagttctattttaatgacatggaaggtgagtcacaggtgtttggttggttgtttatttcatacagatttaactctcctctccaacaggttttcctaagtcccctaagtaaatgtaattttacaattaaaagatttatagaaaaaagatgcgttaactcatccattatctctatatagataagcatttttaggaaagtgtaggcttaattttccataagttttttgcaatgagaataatcagcaatgaaataaactagcaaatacaacacatttatgttagggctgacattacttttggtgaattgtgaaatatgcaacttctgactttcttccctcaagttaaaacataatttaatatttttctctaattgtgttccaaatagaaactgacaaatagttaatttaatctagaaggctattttgttacaattttaaagatttttcttattactggtaataaagacaaatagaatcaatatttataaaacaaaacgtctatggtttatgaaagaaaagccacacatttctaagtttttcagtcaaggatttcatcatcctgatctgccataatgagtaatacaaagttatgaacccaaagcagctacacataagaaatgtactacacagagaaatgtgttgcaaagcaaggagcttttgttttctatttgcataatttaaaagattaactgtaaaaataataaaatctcttgttcaattcatcataatttcatcctttctgctacacttttggcaggtttttataatatgaaggtgtactttactgctttcttaatatctaaatgctctgtcaaataatcaagtgagttcagtaagaggctattaaaaacaaagttaattactaatctgtcacagtctttatttaaatgaatttataaatgaatttaaattagttttgaaagcatcatttcagaatataagcagacagccagtgagtatttacatttcaaagaagtatctactagttagaaaataattgcctgaggaatcaaaatatcttagtatttggcaccaaaattcaactatttttaataaaaatattattgtttagaatctttatgtagttaaaatgagcagtatttcaattatgtcgtatattgaagttatagtcacaaaaacccttagtatgctttacatctttggctgagccttgtctgattcttgtacttgtccttatccttgtttttttctgaatctcttatgggatcttatgtttgtcatatgaaatccattctcttaggctaagttcatcttcttatataacaagatattcttaaatatgaatctataacccagcatactagccacttcttttttgctttttgttggctgcatctttggtgacttcaaccaggttattatttttactttattcttttctttttttctttttctttcttttattattattattattatactttaagatttagggtacatgtgcacaatgtgcaggttagctacatgtgccatgctggtgtgctgcacccattaggggaggagccaagatggccgaataggaacagctccagtctacaagctcccagcctgagcaatgcagaagacggataatttctgcatttccatctgaggtaccaggttcatctcactagggagtgccagacagtgggcgcaggacagtgggtgcagcgcaccgtgcgtgagccgaaacagggcgaggcattgcctcacttgggaagtgcaaggggtcagggagttccctttcctagtcaaagaaaggggtgacagatggcacctggaaaatcgggtcactcccacccgaatactgcacttttctgacgggcttagaaaacggcgcaccaggagattatatcccgcacctggctcggagggtcctacgcccaggtagtctcactgattgctagcacagcagtatgagatcaaactgcaaggcggcagtgaggctaggggaggggcacctgccattgcccaggcttgcttaggtcaacaaagcagcccccaggcttgaactgggtggagcccaccacagctcaaggaggcctgcctgcctctgtaggctccacctctgggggcagggcacagacaaacaaaaagacagtagtaacctctgcagacctaaatgtccctgtctgacagctttgaagagagcagtggttctcccagcatgcagctggagatctgagaatgggcagactgcctcctcaagtgggtccctgacccctgacacccgagcagcctaactgggaggcaccccccagtaggggcagactgacacctcacatggccgggtactcctctgagacaaaacttccagaggaaggatcagacagcagcattcacggttcatgaaaatccactgttctgcagacaccgctgctgatacccaggcaaacagggtctggagtggccctctagcaaactccaacagacctgcagctgagggtcctgtctgttagaaggaaaactaacaaacacaaaggacatgcacaccaaaaacccatctgtacatcaccatcatcaaagaacaaaagtagataaaaccacaaagatggggaaaaaacagagcagaaaaactggaaactctaaaaagcagagcatctctcctcctccaaaggaacgcagttcctcaccagcaacagaacaaagctggacagagaatgactttgacgagttgagagaataaggcttcagatgatcaaactactctgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactatgtgaagaatgcagaagcctcaggagccaatgcgatcaactggaagaaagggtatgagtgacggaagatcaaatgaatgaaatgaagcaagaagggaagtttagacatgaagaataaaaagaaacgaacaaagcctccaagaaatatgggactatgtgaaaagaccaaatctacatctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactctaagacatataattgtcagattcaccaaagttgaaatgaaggaaaaaatgttaagggcagccagagagaaaggtccggttaccctcaaagggaagcccatcagactaacagtggatctctcagcagaaactctacaagtcagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaactggtaccagccgctgcaaaatcattccaaaatgtaaagaccatcgagactaggaagaaactgcatcaactaacgagcaaaataaccagctaacatcataatgacaggatcaaattcacacataacaatattaactttaaatgtaaatggacttaacgctccaattaaaagacagactggcaaattggataaagagtcaagacccatcagtgtgctgtattcaggaaacccatctcacgtgcagagacacacatatgctcaaaataaaaggatggaggaaggtctaccaagcaaatggaaaacaaaaaaaggcaggggttgcaatcctagtctcttttttttctttttgagaccaggtgcggctctgtcacttagggtgaaatgatgcagtggtgtgatcttggctcactgtaaccacagcctccccagctccagttatcctcctacttaagcctcttgagtagctgagactacaggcatgtgccaccacattctctagctattcaaagtttttatagagacaaggtcttactatattgcccagcctggtctcaaactcctgagctcaagtgatcctcctgtcttggcctatcaaagtgctgcgattacaggcatgagccactcacccggcccaggttattattaatatgttgaaaataactccgatctgaagacaggatcctaaagatgtcctcttacatatcttcatctttgttgatctcaatttatcaatctgtactttaggatctggggagagaaaacattcgctcaacctgttattaacttaactcagttctatagtgtgttagtccaaatatttcatatcagaaagcaccttgtagaaacatttgtataagtacatatgctagtcctaaggttcacctcaaaaagggggaggtgtttggtatatgtccttagcaaggtttgcaacaagatttttcccctcataatatcatatgtatatattttatgatatatatatatatatgagacagagaaagaaaggctaatctgttatgacttgtttcattaaactagagctttctctgaccacgcaacacaaaagagaacattttttgattcactgctatatgttttttataaattacaaagatattatggtaaattccaaacttttcctacataagttttataattaccaaattataatgataattatctcatatataatttattttataatttggtacagaatctcactttgtaaattcatacatcattttcatattccatggaaaaacagttctttcatcattttaattgcttattaaagatcctgtgcaatcagtccatcatttttctctaatatatgaccatcttaaggtgcaattcacataagccaggggattgagctcatttggaataccaaagtattgtctcggagttcaatttctctggactttattccagtttattcagtttaaaatatttcaccttgacagaagacattattaaacaagaagaaaagtattccactaacattctgtcatttatgtggatcccaaatggagggtttattcacttcctggtccttgctccaagtattactaaatgccattaatgtttctctcattctaaatgttctttgaaactaacattttgtctagtattctgcaggtggtagcaaaataaaaacaaagttttacattcaaatactattggtttctttagccacgtttatgcattattaactttttctttttctgccattgttctgttaatatttctaggtatacagtacatctgcttgtactctcagctacctgaaattattctatttttgaaatgacaggaatatataccaatacattgatagggaatatcaactctaactcacacacaaatacaactattaataatagcttttgtgtactgacttgagaagtataataaaaattgttggtcaggcatggtggctcacgcctgtaatcccagcactttgagaggccgaggccaatggatcacttgaggtcaggaatttgagaccagcctggccaacatgggaaaatcctgtttttactaaaaatacaaaagttagccagctgtggtggcccgtgcctgtagtcccagttactcgggaggctgaggcatgagaattgcttgagcccacgaggttgcagtgagccaagatcacaccactgcactccagcctgggcgatggagtgacctgtctgaaataaaatcgttttatttagttggcatatataagcacctttatttacctcaaaattctgtgaagtaattatgattatcatccccacattacagataaagtaaccaaggtacaaatatgttaagtcagttgtccaaggtcacatagctagcataagagaaccagtagaggaatctaaataatctagttccaggacttgattatgctaaccacttcacaataccacttctcatattttgtttaactttacttgcatgcttcttatcagattttgatcacttaactctaaccaacaaattcagtttttgttgaagtagattctcatcatttcttctatgctttttactgtcaactaggcatgccaagagctcatcagtcgtctgctttaaggagattagatgtcccatctcttttccagttctaaggtgtgccctaaacctgcctccattttactacttttggaccttctagtatgctgttaataacacttcttcattaatgtttcttttttttttctttataccgctttatttcaaccttcccagcatgctagatttccatgtagtgtgtacccatatgacacctggtcttctccagttaggtcaatttctttcttaaaaaatgtatctcaataataaattctagcccccaaaattttatgatttcctttagaatatgtatcattctgccatacctatgcataagaatattgaaattgtaagaacataagttggttttttttctttttttgagacggagtctcacactctgtcccccaggctggagtgcggtgatctcggctcactgcaagctctgcctccagggttcacgccattctcccgcctcagcctcccgagtacgtgggactgcaggtgcctgccaccacgtccggctaatttttgtatttttagaagagacgaggtttcaccatgttagccaggatggtctcaatctcctgacctcgtgatacgcctgcctcggcctcccaaaatgctgggattacaggcgtgagccaccgcgcccagccgaacataagttttatttgtggttatctttcaaagtgttgcctcaagagaggttttgataagcttcatattatttctgtttatttcagtagctaacttatcaactgattaaagataaactcccatttttaaataaaaacaatgaaactgaagcaaagtttgattttacccaatcatctggaccttaatatatcagtatatgatttctatattcatacattgatggaaaatagaaggtagtacaagtaaggagactgtggtcttagttccagttctgtcaccagctttctgattgagttttatagataatttgaatgtctctttcctaattcataatttattcacaatcttggtgattatatataaagtacttttaaaaagtgtttttgacactatgattaatgagttatttattaatcaatacagacaatttgcttcacatggttgtgaacagataccacaaaactgctagacaaataaataagcaaaataaataataatgaattgcaggtactaaatattagatatgtgggagcagttcctgtataggaattattgtaatagtagttggtagaattacatccataaacttatattgtttacttcctggacaagaaataaaagatcttaataagaatgtagctcaggaaaataaatagtgttaggatctcaaacaacacatggttatgataaaggttataagttttatctcctttgcaagaaatagggcaggcttcagtaccacctagtgacaatggtgaatggtctcaatggcaaaaaacagcctggaggagaaaagacaatctgcttttattgtattagctatttggcttctatctcctacttctattccttttttcattcttctgtaagataatgtgtttatcctacttttggtttcttcaaattttgcaataatttaattcctgtacaacactaaatcaccatggaaattaccctgttcatacaatgaatttgaatacaaattaaatgatcgagaaatacattcaaaaactttagagcatgacagtctcataaatatttgtatataaactgtctctacatctctcatttatagggtttctattttaacatgatcctttgtataaaaatctgtatttatttacatttctttttaatatttttcaaaagagctacttattaaaaagttctgatctcttggtataatcagaacagaaaaatatagagaaataataacactgatgaatgtaagggaaaggtgcccctcaggagaatgatttccattaaatgttacagattactacattttggtttgatttgcctaatatttactgatttcaggcacatggtaaatttcttttctcttctttttccttaagaattgataactcagtcgaggacagaattacaaaagttgtagactaaatgtaatcataaataaatggcacattaatgcttacttttagcttgggagcaatggggagataataatgcccaccatggaaatgatacctttttctattatattataatttcattgaactcagtaaaaatcttttttttaaaaaagtgaataaatagctgaccttaggaaaaacacaacatcaattaaaaaaatctgaaaagtcacctaaaggccaaaaacatagtttctggaaaattaagaaggtcaaattcaattatatccacatttggtatgtagttaaaattcaacatatttccactagaagcccttccccatgttgtaggaatcaggattttagattatcacattgatcacagtagcaaagggtagcacacagtgatctctaaatacacatcatttgctttgatggacattataagtagatattataaataatattcattctatatttagaatataattagagaccattttaattgactttatgatatgctcaagaaaacgctactggagtatagagaatggattgtgattcactgctatatgttttttgtaaaatacaaagatatggtaaattccaaactttccctacacaatttttatcattaccaagcttatgcatgagaataaatgataacagtccacagctaggtgtgcctatttctctatgcatgaaatatgagatactggatgtagaacagagacaggtattgattaactcttatttggattggagctgtgtttctgaggcacctagctggtaaatactagaagggtatttagttttttttttttgtttttttttttaggttccagggtacatatgcaggtttgctatacaggaaaattgcaagtcacaggggtttgatatagagattttttttttgtcacgcaggtagtaagtatagtacccagaataaattacatctctaaaaacagcaaacacttctaaaaaatgatggggtatataagatagtaagatagaacccaataggtagttttcctatcctctccctctcccaccctccaccctcaagtaggcctcactgtctgttgttccctaaaagagtatttaaatgttaatcataatggccctatgtctagaccctcaaagtttaaagaaaatgggccaattagtctattctatattttaagatctcatttaataaattgcttacagtggttgatacattataagaatatatgtataaaatagctgaaataagttaaaggtttaaaagccaaattcatcataaaatttactcattactccagaataaattacatctctaaaaacaacaaacacttcaaaaaaaatgatgggttatacaatggggttacgaaatgttcgttttaggtttcaaaaagtgtccctcctattctttcttatatcccgcatttatcacatggctttcttcatgtcacttctgattctgtcatatatctctagagtagcataattagactggggtataaagcaggagggataaaaatgagatggaatagaaaaagcaaagtgtggagagcctttcattatgggaagcaactatataatcttgtctggaaaattatctgaaaataggcaacttagcttacataatttaagtctatataagtctcttttaaacagagaatgataaccttgaactctttagaaagagaaagttcatatgaattgcctgacatccgtatatccgtaaattgaataatacagtagaaactattagtctgctattccactgattcccagattgaagacaatgttactattttattccaatctgcatcaattcaaaacaacatttttatgtgaaacgtaaatatatgaggagttcagaaaaaataagatattataattgcctttctttgccagattcttttgaatttacgacagtagtaaaaggaaagaccctaaaacccaacacacacatacaaaacacaatgacttttcacgtatttttcatatacattctgagctcttccagcagtgcagccaattcatggttgttttctataaacataaattggcaatggtttataaaagatgaagttgtctggggctcatgaagtagaatggtatggtgggttcatccttaatccaaggggaaatatggattttataaccagctaccatactgtctctggctttatgcaaatggaataacaattctgtttcagactctttatctttaaaatggtaaatgtatttttactcatttccttcaaaataggtgagataatgtgttatacatacatgaatactatatttgtgaatgtctcaacaacatttagaatagcaaggatataacggagaactaagtctagcaaattaatcattttggaggaaatattagacagcaaaatacttttttttcttcaactttatcaggtgccacttgttagataaggtaatttcatgaatagtgcttcttctgctatttgttgcttaaaatttaagagccagtctatgtaagcgggaacaaaaacatgtttggaacttaacggcttggtcttacattgctaaagcaactcaaggtcaccatagccaatatacaatctcatcaatatcctgtatccctctcgatgatgaaattatagttcgatttaaaattttctgaaatacacattttatctgaaaacaaaatatcagattagagttgatttccttatttttttcctgtaagagaatccacatctgagaaggaagaacacagtatgtgaaccctttcccttttgtgatgaggtcatgtttctatccaatagagagcagttgccaggcagactttgctaattgggagagacaggacagcaaaggagaatcgcaacactcagcaggctgctgacctactttattattataactcataggagctacgaaggcatttttttttccagtagagctacagtgacttgtcagcaaattagttaccctttgttaggtcttaaaaaaaaataaaaaaaaataaaaaaaaataaaatctttctgttatggcagtacgttctattttaaaaaattaatattatcagaataatacaatttctaagccatagaaattcaaatctaaaatagattactgaatctcaagagaggggaaatatatttttaattaagagattttttagctcatttcttcgtaatattactttggctatattatgtcaatcagtcattacctaagtagttaaatgggctctgtaaacaaaaagtgaatctattttaattttgcccttaaatatttgatagaatggcaatagataaaataattgtccgggtttctatattctaattgtatatgtgagcttacatatgaataattctcattgctttttttccaaattatttacttaaaatatcaataaatagctctctcttctctgcccacccagcacacatttattgggatgattatagtttttgagctagaagtgcctgaagtatcttgattccccactctattgaaggttcctgatctaaagccagctaatactacttgaaatgaatgtctctctattttgtgtctccctggccctcggtttttcatagattttatttcaatccacacagggctactactagaacaccactggatgagttagaaaacagactgtactccctgggtatctaaattaagaagagaaaataggcttgcatggcttcattttcaagggaacacagtttggaaaacagaaaaaaggggagtaattcaccagcacttgaaccatgctctttgggcagtgcaaacatttcagagctctcaattcaaattcctattaatagatatgtcatataatttaccatttcactggattataaatgtattcattgttgagcttacattttgtcaagttttatatagtttttagtacccagaaaagatagtttgaataaaagcatgttagaatgtaagcctaatgagggcagggactttgtctcatcctctaccatgtgtttagtgcctagaataatgtctggaacaaagaaatactcaatagatcatttaaatgaaaaaatacataatatacacttaattcatagctaagaagctacgtacaagaaagtcaagtgacttgcataaaatcagcagatttaggggttgaggtaattccgatatgtatgtctttaaatttaattctgcaaatttcgccccctatgtttctgtacaaacgagttaggataggctatgttatgtgtgagcttcaaattaagacatgcttctggaactcaaaaaaaaaaaaaaaaaaaaaagggttgagggcattatagcagcttttcaatgcttatacctataagtgaaatatactgctattcataggccattaattattaattaatagcacagacaggtacccatctaactgaaaggcagctagaaaatatggaaagcacgtggctatttggttgttagtaagtgtccctgtcacattgtttcaaataaaagtaaaatagagtaacctagattttccagtggaatcccttattctctccatatagattttactaattagaccattacagacattttttatatcagtttttttctctgatattgctagattggtttacgcatcttaactttttggaaattaatatatctatagatatgtagagaattagaggcttattaattttgacttcagcaatttagagtatgtccacgagttctaaattcagtaatttagagtatggtcaagtgattgattacttatctttgaaaaaaataacttgagatgcacaaatcattaaaacaaaaactgtataaggaagaccacttaaatagataactgaataattagtttgcacatattttaaaaaatgctgataattaccattttgattataaacaatattttagttagcaacacatgcagagttggtataggagttgtctaggatgcagatacatgaaagaccaattgtctgcactgtagaatagcacttatcaaaattaaataatgcacagattccttcaaatcacaacaaatgaatcattacaatgaaatacccttgacttgggttaaattattttgattataatgttactcaaataaatacaagtataaaactaaaacaaacataattttacaaatcaaatacaaaataatgaatcaacaaatacatcttaatgtaaatttactgtgatgagtaatgctgttttgctaaaaccaagtaggtgcataaaatgtaaatgtagtgctgtaatgccaggttttgtagattgtgtgattttatacagtattctacaactgagtgctatggaatgactaattgacttatccaagtttttcttcattttgactacggtgaaacgtgtacaggatttaatatgttattaatctttcaattggtataaatgcatcatttatttgttatgctcaaaaaccagaattatttgatgtaactcctcatgacacaacctgctccaactacaaaagcatattcagattccatatgtatgacattcagataatcctaaattcataacatgctatgttaaaaccttcaaaatgattactaacatgtaatcatatatttataagattgctagtagaaaacatggactccctgacagtaaacctatagacttttaaagaaagattgctctaggaatgtactgtttagctgaaaatccttctttatctgttctataaagtcattccctaggttacatccgatatttgagattcagttcaaaattaatacgcaagttaacgtgcatcatttattttcttatattcttaaaatgaatatttcatacttgtaattttaacaaaaacccattactcccaatcttgtttataatgatttaatataattttagtgttgtacacctaaacacatagccacaaaatgtcatgggaataaaactaatcttattagaaagtaattatctgctatatccaagattttcattcagatagaattatataattcagacttatttcttgaatgaaacaaaaacaaataatataaatacaaagcaaagttacttcctgttcacgttgtgttttgcaagtcagtatctccttcctagtcaatttaagtagcctgcacttttagtccgctttccgttgttacaacaaaataccacagactgggtaatttataatgaacagaaatttatttagctcacagtcctggaggctgggatatccaagatcttttaaagtttcatgtggtgagggcctttcggctgtcccctaccacggcataaggatagaagggtgaaagggccagcaatcacatgtgaaagagagctggagatagccaaacttatatttataactaacccccttctccaataacaatattaacctgttcatgaggtcagtctgctctttatgtaatcacctcttactagactttgcatcccaacacttctgcagtggggattaggttttcaacacatgaagttagggggatacatttaaaccatagcacctgcgacggttagtgattgactttttaaaaataatatttaaataaaaactttaatgaggaatttagaaagactgcaaaggaattcactgagagagattgaacctacatttatggaatgaaatagttaatataagaatagatatattaaacaaattatcaacactacagttacagatacagtataattatagcattgactttgagtttctcctcatctagctagtgggatacagataaaagtatgggtataagtgcagatacagttaagaaggatataaatatatagtaattaatatttaagaataaaaataatttaatgatggaaggatacaatgaagaagaataaacataaagaatttgttagacccactaatctttattataaataatttagaatcagagcctaaggtcatagcatgtttgtcaagcccaaacccaagaaagacgagtgcattcctgcatatatcctggcctggctccttaattttttgatttctcaacttgattttggttttctacatctcacaaaagatcaatcttgccactttttagtgtcagagctcaaacgttaattttaatgggattttctactgcagttggagtgctttaactaacaggttttgtctctttattactaccttccttaactgttctttataatctatgctgcacaaaaccgtccaacatggtttagagcagaaattacagagtcagatatataagcattctactcttggttctataatctagctgtgtgacattgactattcatttaacttctaaaaactttagtttttctagccaaaaagtggggcaaaataatgtttacctcattcagttgctgtgaggaccaaataagatagcatccttcaaagcacagagttttgtatatagtaagtgtattaaataaatgcagggtgcttttgttctcatattggatttgcacttctccattataactccttgtgcataaatatactttgctttttattattgcaataaatgatttaccaaaactccataactttagaatggaaaaatagtatcttcaaggtcaaatgataccatcaagattctctcttgattcaaaaatggtcttttttatggttatttccttcacatcactattatccacaatataaattaggccaggcatgatggctcatgcctgtaatcccaacacactgggaggccaaggtgggaggatcacatgactccaggagtttaagaccagccttggcgacatagcaagacccccatctcaaaaaataaaaacaataaaataaaataaaataaaataagttatggcttttatatttgaacatacatgacggtttccttctctctacattcgagttacacatggaaaaatgttaaataaacacaagagaaaataaaaaccaacttcatatgtaaatctgcagccaaaaaaaaaaaaaagccaagaagtgaattgcaaattctggaaagatattttgtataatgtcaggatattaaaaaaggttgaaggttgggctatgttggaataaacatactacacacacacacaccacaaacacacacatgaacacacacatttgagcacatatagacatgtttaaagaaaaacaagaatttttttcaataaatgtgtttatcatcagatatattaagtagtatattgccttataattatactaccatatgtactttatagacatcccaaaatagttattttactatatctatgatgacaattggtatttttctgaaagatacataggaaaaatgtaaaataataattttttaccaaattaaatattggttggtgccaatgaatcatcttttggcagtagtgctaatgtttttatactatcctctcagtcagtagccagattatagagctgttgccttttcttctcctgaaaaatacaattattactatttttaccatatactttcctccttcaaaaagataagtaaagtgacagatctataatcaagtagacatcacaggtttgaaaaatgagccaaccaaactactgcttactttgttctttagttatcgaaactaccatatagaatatttctcaaaaaaactgtcaatgataagtgactaagtcacaacaaattaatgtgtcaggtactattctaggcactttctatggtctgaatgtgactcccaaaattcatgtgttagaagcttaatccatattacaacaatgttgggaggtggggtctaataaaggtgtttaggtcatgattgctttgctctcataaatagattaaagaaggctttcagaagtatgttcctgccgcctttccaccttctgccatgtgagggatagatttgtcttctctggaggacatagcagcatggtgccaccttagatacagaaattgaacgtgctggcaccttcatcttgtactctccaggctccagagcagtgagaaatacatttctgttttttataaattacccagtccatagtattctattatagcagcacaaaatacaccaagacaccactggaaatacaggacagaagagaacagacattacattctggtgtggggaacacagaaaaatataaataacaaataaaagtgtatatacatacacataaggtggtcaggagagctctttgtgatttagtgatatataagcaaatattaatgaaatgaagcgagatctaggtaaatataataaatatcaggtcaaatatcaatgaaagcatagaaaagacaaaaagaaaaaggaaggaaggaaggaggacaatagggaagaagatagaaaaggaagaaaagaagacaatacatcttaactgtcaatgtaaatcgccttttttttttcaaatagaaaacctatgctacaatcattaggagaaaaaatcataatctttggtgtccatgtaatttctacaaaaataagccaacaaatcaatagtagaacagtttgagaaaagacagtatttgatttatacctaagggaaaaatgtaaaaatctcataaaattaaagtaccataaaatgtcacacatcaaagagggctattcacagttaaacaatgttttattaagtaaaaatgtaattaaaatgtaatgcaggaagaaaatatgggaacttatacaaaaagaacaaacatttgtgaacacatatgtgtgtatatataaaatatatatagagagatttatagatatatcaaccaaaatattccctgttcttttaattcttttgtgagtgttgagtgttgcattatatagatcaaaacatatcttcttaaaattaaataggaatatacatagctatttaaatcaaatttatactttatagttttttaaatatttacataactttcagaggtaaatttaaagcctaccttttccccgaagttttccttattttccttagcaaaaagtagtatctgaaacttcatttggcttcatacatatttaatctatatctatgctgatgtatctgcctttgcatgttttacaatccctaaaagtgtatgtcttgaacctagtgaaagctaaaaaatgttgatgaaataaggcgttattctaagccacaggcatttttgaaagaatgctgtactgtggtaatattttatgattgtatctttgaaataagatatgcctcagtatacacagaataaaatatataaaagtagatgttgtaacatatacatactcaggaacatagtcaattagtaaaatttagttgtaaccaccctccacaaacataacatctgattttatattcatagaagcaaaatcaagttgtctgtaaacatttatagagaagaaatcagatcattgtaacataattacttaaaaggttttggcacaacgttgaaaagtcagagtgtaaaataacagaatttacttacaaccatttcatttaaagacacccagcaatctggtgggaagtcctgcagtagtggtactaagaactgaagacaaccatcccagtggcacaggagcagcatcatgccgatgagattaaaaattctcaccactgcactggcgagatcatatgtcatgtggaatatctgttgaccaaaatataaaatcaattcttataatcaattttttagaaaaatcaagcatactactgatagtaggcattgatgttgtgtagcgtaagcattgatttaataaaaatatgggaataacttgcagaaatagaaacagattacatttctttatttttacaataaggttgacactccactttatgaatattaaagccaactatgtctcatgagcaacagagatagcatgaatatataaatgtatgtattaaagaacatcgatgttgccagaagtttttatttattgttcttttgcatattttagcaaagctactttaaaacaaggtagcaaaatttacaaatgatgggtagcttctactctgcttctcatctcttgttatattaatagatttgttgaaagacaaagaaaatacccaaggactgaaaaccatatgccaaaggagttcagctgcaaaatatgaagtaatattgataataaattacagttaaatttatagctatgtgagtggagatatttaattgtggatactgaacataaatagaagcctttgagataaaggctacctggatttggtttaaaaacaattgtgcaacacttttaaaaatcataactatttccataaactttttgtatttttatggtacaggctttacttttcagttactccttattgtttgtattttgatgaaattcagtatggtaggttagattatttcagaaaacacaaacattatgacaaatcaacataatccatcaaaattttataaatggaaacaaatacccatctttacatctgtaactactcatttttctagaatttacaagaaatagattcagaatgtgagtcctttctttagcagtttattgtactctctaactggctgctaatatagtttctacttatattttacctagtctagaatagcaaaacccacttgggagcagacctacattgtagaactaagttttgttataattgttaaggaattactgcattaataaatacaattaaatttgagtaagtacttataaacacaataacttcagatatttagaatcactttttgtataattcaccaaaagaatggtgtgtttttgaagtaacaaggtaaacttgtattgaaaaattatccaaaaaatgtaaagaaaaccaaaaaaaatacatttggttttagaaatgatatctttgtaggaaaatatctataattcttaaaatacacacactgaagtactcagaggtaaaatgacagggcatctgtgattttgcttttataaaataaccaaaatctgtctttaattaaatgtttttcagtttgatatatttctatgagcattaattctttctttaaacaatctttttgacatagtaattatagtgagcaaaaagatttttttcgtgggaatatacacactgttctgaattctttttaaaagaaagttggcagttctaattttaagggcaacagaccacatattttgatattcagacagctatacacacaacttattatatagcattaagaattttacttttctgtaagctactttttattttggttttaaatttggaaaacctacagaaacatccttttgatattattccctctgatatttcttggtcactgaatacataaatagaaactctactaacaatttcatcaataatttctcattaaaagttatataatacaacataataaaaaagctttctactgataaagtcggaaaaagtcatcatgaacttagtttttttgttgttgtttagtaacagaatttacatttatatcttaatatttcctgagaaaatcatttaagatgtcttgtggataaagactgcgttttgttgggaaatagtgttaaattgcagaatataaacttctggaaaaaccaggaagcttatcacatttcagcccaattatttgaggcaactaataactatctgaaaatattacaaaatctacaaattataagtatacaggcagtggccatcattcaattatcaggctttagagtggagtatggaatggtctagagaactagcatcgattcttggtagatctgactgggtttttcttgcattttctacttccttttgggaaattagattcttttcatgggctctcaagagataaagataaaataatatgctaagttattcaattcctttaagaaaaccctattatctctaaaatgttctctagagagacaggaccactaatttcatagaggaagttaatggggatataacatcaatgataacactttagaaacactttttgttttgctactatgcattttcatgaactattataagattatgcctagattcaagcctatctgctaccaaatagtcattcccaattccataatgttaggtagtgctagtgctggcttcatacagtaactctactatctttagagtactcagtaagaactcacataattaattttataaacagtctcccttatggacattaatattatgtgttcaaaattgacatcacttttggagctatcccaaaatttaactttggagaaggtacaagcaagttgggtatttttacactggttaatagcagaggcaaatttcaactagtcaaacccatatatcttcatctttatttatctaactgataaaagagcatatgtaaagtatataatattacttgtgatgaatacgtgaatgtgtgcattatctcggcccgatctgattgtcttttgaacccttataactaagatactctggcaggcataatcattacatacgatctgaatactgagattaatagccctgttaaaactttactcaagaaagatttggaatgagaaggctacttccttacggagctcacacatctgtagatagtcaggttaaccaaagaaggaagcatctgatctaatttatgcacagccacaacttattattaataagggcagcttgtaggataaatctaagtgtgactttattcaccttactaatcaagtggctaacactattgatcaatatttttagtttttcttcatctataaggtggacattcttaagtaataaatttccatataaatcaattgtcttggtgctattgcatgaaaacttgacttcatgtaaaatggcaccatgaatgaccctcagtaaattgttactaaatgaatgaatgagagagttgaaggggtttaataataataacataaataaccttttatggtgtaccactttgcttctgtatcttaaacaagggaattaaaacaaacaaaaaaatcaaaaacttcactattattttccatcttctaagtaacctgacttgaaacctaacctcaggttagggtaacagggtaagagggctcagggttggggtaacagaaagaaaggctctcttccccgactagcaatacacttttaagttactttcaagtggtatttacaggagtcaactgaaaaaaatgtaattaaagtaagtttttcagccaggtgcgggggctcacacctgtaatcctagcactgtgggaggccgaggtgggtggatcacaaggtcaggagttcgagaccagcctggccaatgtggtgaacccttgtctctactaaaaatgcaaaaattacccgggcgtggcggtgggcacctgtagtcccagctactcaggaggctgaggcaggagaatcacttgaacctgggaggtggaggttgcagtgagtcgagatcatgccactgcacttcagcctgagtgacaaagtgagactttgatgtgaaaaaaaaaagtttttaaacaactctttaatcttattttcaccatatctagactacaaacaatgtctttaggagacacggtgctttacatttgtccagctcaggacattgtgctgttcatgtgaccttaataagaagaaagatctggtcacaaattctcattgaactttttttatattataggtttagaattttatttagttggagtccaataactccagacaggataaataattaactttctaaaactgaaaaatgctctaggatattttaagtcagaatcccaaattctaccttaatatttgcgaatcgttcatcataaatgtgattttttgtgatattttcccaggagcaatgtttatttcatcttgtttttaaaaggtctttctaaactgcactatacaacagatatccataaattggcttaattcttttaaaatgcttccatattctttcctgatgaactggattcatcggtctttcaatctaatagcttgtatataaaacgaatgaccttaatctatgcttaattatttgttctattttgtcttccttaaccaaaaaactatcaaaaataattgaagactctttatattgtgcattaaactgcttttagtcgttgactttacatactgggataatttctgagctagtttgtgtgatctcaatattgattcaagacttcttaatacaccttcgtaagtatcaaaataagattaagaaaatgggccaaaaatgcctgtcttgacagagaacattctattttaaaaggtgtaaaacaaggttagattcttctgtttctctttatatttcggcacctgcacgatttgttatattttttagatggagtgtatacataccatcctgacacaaaattaaaaaaacagctactcagattcagttgtactgttaacatatattcagggctcaatatgtaatagtcctaatcaatggtaaaataaatattttaaaagccctattatacctctgtgattcttgccctgaaagtcattcaggtcatctttccatgctttaggtacaaagtgtagaaggttttacttcatatgagagaataacactcttcatagtaatctcttttaacactgaccaatgactgcagtcattggatgaatcttatcagtcccctttttaactaggattttatttggactgagaataccttaacattcagaaggtcaaccatctgaacatttcaaaactatcatcttctgtccatagtccaaaagcaataatccactcttcagcctcctccaagtattgtcccatactcatgctcttgagtgctttttacctggattcttctttccactattccttccaaaattcctcctacataatcaattaattatcaaataccctcagccacctcacgaaatgctttctctacttctctgcttttcctgagacttaagactctccccaccaccttcccctccccaaagacgcaacttctctggtagctttctcaaagtttgttcacttctttcaaaccccaatgtcttaggttctgatgtgagtgcccttatttcctcactgccctctgacaacgtcacacgttatttgtccagctatataaaaaattattttcttaatgttcattctatttgcctacactacccataattttgctcatttctggcatcaaacaacctcccaatgtccacgtgccacacatctccatttattaagggctctgtccttttccactgcattttctctgaaaaaaaaatgtcaacttctgattaatcaaaacagccaccttgtatacctaaactttggaagattactggagagcaaactgtgtagcttgtactacttaattttttttaaaggatagcaaccttagttgaggccctcagcaatggtctatccatttccctattcctaacaacaacccattctctctttctacttccccaaagcccatgactatcttcttcagtttcagcttaaagttttatattttcaaaaggaatactcttatagttgaattccctcaactttgggggctagattaacccccaaagatttaaaaacaataaaatctctcaattcctaaaaaacattttaattgaaaaagaatcttcacttcctaggtattttcctaattctttttttccctctttttagtcttctctgtttagcttctcaaacacaactcatcggaactttgagacacagagagagctggcctgccttacagggtaaaacaaatttcttctcatggctatatgtacacatttccaggaggcacaaagcaaaatttgatttccagaaggacagatgtttcatagctactctgggcctctgattctcaaaccaacccatatatgaggaaaatgtgaagatacttcaggctgactttatttcccaaatggtgtatcaaaacttaagaagtctttcttctgagaaatctttttgaagtggcacagatatgatgatacctttgaaacattagagaaatatatgtctcattacatgactgcagtgaagaaaatagtacttttcataacaacgatatgctcatataagtagttatagaacagaatgtattctttatcaatcatgagttgtaaaataaagtataggtgtatatgttattttaatccaggtgttcctttaataaacatatacatgtttgcataaaataaaaagaaagcaattttagacatttcagttattttttagaaacctgttatgtttcttaactaccttttcaactatattttaccttggctattactcagaatttctatatatgtttcattttatttgctgctatgtgatataccatccatttctatgcatacatattttttgcatagaattttaatttcatctatctaaaacatttatgaaaagtgtgttttttatggaaacttgttatttagctttaacagtctgagaataatcagagataatgtattactaagagaaatatcaacaaatgggaaacttaagatatgaatcctttgaacatttttggtaggaaacaatgacaggaaataggtataatgtaaactgtaaaagtacaaactttgaaatctgtcaagcacaatgcctggtggcacagagctcgtgctcaacaaatgtttttcctcctatagaagttattcaactaacaaatcaatttgtataaaggggtcagtactaataaatatctaactgagctgaactgtttctattaattttattcatttttcttcaaatttcaagtcaataccagctgacaacttggaataggtcaaaaaacaaaaatgttttgataggtgacattttggtatagttatattttaatattatagagtcatatttaaaatatcacctattttaatatgataggttattttttaactgaatctacccaaatctttataattcttaagttccttaggaaaagaaatacatcttttcaactttcatgatgaccatgtgacaggtcagaacatttattaattgtaccatgcccaggaaaaacgaaagagcaagcataacctcatatgcttaatttattttaaaaagcagcttaagtgatgggaaaatctaattatgaatgaatattggaaatgaccctactaagaagaaatttcaatggattaatactctaaaaaacagactaaaattaaacaatttaagatcattgtctattcctctattaaaaatttcaaatggctgcaaatgtagacgatatttacaaattgtgcaaccactgacatatttaaatgaggcgaaaaccacatatcttatgatggatctttgaacctcattttaatgatgtttgtctgaagattatttgatgtttactatacacacttaatttccagatgtaagtcagcactaatatattgatttgattaaatatcactattattttctgaagtttttttctaaaatttatcctgagaattcaaaataaaataccaatttttaaattaaaaaggcagtgttcttttcattgtgtagttcttacacattaaaaagaataattaaaaatcctaattataaaggagtgtgtgtgtgtgtgtgtgtgtgtttgtgtgaatgtagagaaagatggtgaaaaagaaaactaatagacaaattagcaatattctattaactctgctttggtttttccactaaaagaagtgagagtgagccttacattggggcaaactgcacaatgtctttaacatcccagcctcctgtcaccattttaagtctaaaaaggcatatgccaactcgcttattgcaccatttgataggtgaactctataggggagataacagaaagaaaaacaggcttctgaaaaaactgttaagatgaaagcaaagcttattcataattttttatgcattggtcatcacagttacatcatgcattggcacagcatcttgttattctggccaggtaagccagtcaagtgcggaatattaatttatttgagtgggtttgtgtcagagatgctctggaagaaacagaggtgttggtttgctgtcttggcatataccttccaaaagaaatcactaagtacatgattttggtattaaaccaataatattgcactacaattctttgtgaacaaaccatgcattcttccatttgattgaacttattaaaatataaaaacatattagtgcaacccccctaaaaaagaacataaaccttaaaaaataaggaagcattggcaaatttgctagcaccccaagaaacaattgagtaagacttgatctactggaaaatggcatgatttcagattcactagttggacaccttccagaaggaaggcatcataatgctccaccaattcaggtaataatagtacatatagatacatgatagatcaccttaagtgccaaaaatacttaactatctgaattgtcgaaagtttattgaagtaactaatctatgtggaagcatccttaaaagtaataagccttatttgtataagtttgatttttcatatcactgaaaccacctattaagtatttgctatgtgcagaaagtaatattaggcactgggttcaccacggcttatgacaacatcttccacatcctcactaaatcacatgaacccttaacttttctagagacctctcacttgctttaatcagcactcatttttctctagacctactggagagctatcataattgttgttttctttaacattatcatgtaatttcctcactctgtctcagtttatagttttatttaagtgggagattggttagaagagtaggtacatgtttgacaatatctttctgtcttacctgtttaataacaccttgtctggatatagaattctagattgaaaataattttctcccagatacttaaagacttgactccattccttcaagcatttatcaaaactatatctttccccaaacataggtttaatttctttagtgaaaagataaagaactttacattaagataaataaaaatggcccaaaatctatgcgtgtgttcaaggggtgggaggcaagaaatggatgatgattcatggaggtataggactgactttaaattaaaattccttccaatatcctgacctattgctcaactacattctccattataacttctgactccaactccaaatgtctcaaagattccactgtacagattggcccccatttcttttgcagactcagttgtagcatatctccgaatgtgattttatctccttgtgtcagtctgtattcttcctccccttgtctttcaactcttaaaaagtttagtgtctgttctgtcttaacgagttccttgcatttgtttccttttgttttatagatgtattcctttactcactttgattctttaattgttttggactcaggagcaacagaaagcccacatgtgttatcttatccctcctgctgaaccatgaacgtttatcttacaatgtgtattttcttcaatcatttgaattggacttatataacattgaaagtatttatataactcaaatccattaactgcatgtttgagcttcatacacttgtattccaagataaatttgaaatcactttgacagtccctctccaattcataaaattatgttggactgctgttactgagttaattaataaattgatttgtgtctatcattattttttcaaaaacttaatttacctcacattcaatctttccttccttgaaaatatggtccacttggcatccagaattatcattttacaattcaaacctgatcatgtgatttcctgcttgaactttcactagacattcaagaaatctttacgaagcccatattcttggcctggcattaaaggtcctttgtgatgtggtctctgtactaccattttattctcatctctcacccttgttctgtaggtattccaagcttaaggcaaacaaaacttgtcatagtaccctttaacatgattgatcagagtctgcatttgtttacatgctattctctcctggtatactaccttccatcctatccattttctgactgatgaccttattcatactcaaatgttgcttcctcaggaaagacttttttggcctctccaaggagaaaattaagcgcttactccaataggggcttgcccttaactctgtaaaagtgtttaatgcattgctataattacaggtttatgtgtctgtgttcttactagatagtgagccctagaggtcaagaattgtattcacaaaacatgcacttaacacgtttacaaattagaagaaagtaaaagaacggaggaaaaggggaaagacaagatggagggaggaagggaaggaggaagggagggagggagggatggagggagggaggaaaggaaagaaggaaggaaggaaggaaggaaggaggaaagaaagaaaagaaggaaagaaggaaaggggggagggagggagggagaaaggagaggggggagatcccagttcagaaacatttggtatgactatatattgtttccaaatactctttgtgactatagaatagggcctctaatctgaaaagaatacttatcacatgtctgtaataaagtaaatttatatacacatttcatttgtaatttgaatacccattcattccagaatacctgtcatcttttgttacatccttcatcacatcacaatatccatgtagtctttgtcatcattgtggtctgtcctcatttgagctcttaattacaaaaatttcattctctggtcacatcttttttgtgtgtctagcttttagttgtcattgtcttactctctctgaactgttttttaattgttgaaaatgcctaacctttacagagttctactttctcctgctctcttttccttgctcatcatcacttttttccatatccagtcagacacaaagatccattatttcaaccagtatcttatcaaaattttcaatactcttctcctctgttgtattcttatggtaatattttgttccaatattaactgactgtccattttctaagttctatacataagcttctatatatctcgagagaaccttacaactgcacaactacttcatggttttaacatcaactatgtttcctatactgtctagtgatattggcgtatttctagatagcatgcatatattctccagtgcagctagttaaaaaacttacccagattttccaaaatctatcatactaagcctgcttacctcaatcatgagaatacacttaactttcaattttattgagaaaacattgtcatttacaaatatctacacttaccctttcttcttacactggtgcatgatgtgtctctttttctctctgatgcctcacctatgtctctttttctctgtgatgcctcacctattttttttctttttttttcttcctatataatcagtgacattgcttcattaattacctcctgtcttcttcctaggactctatgtctgtttttcctcaccatcatttaagcatgcttaaatctttcctatattagaaaattatgttgacctggtattcctctcaatcctctttactaatgtctaattttcttctcaaacactgaaaagttacctacatcttcttcactttttatcatgcattcaacttttaaacatcttgtaacctggcgtttcctatctgtcatctgaaaacatccacgataaaattttcatatactgctgttgctaaatccaattaaaaatttgtaagccacatttggttgacctctaggcacattaatttataatatactctttgatactgctttcttggtttctgaaatgcaagtttctttcttgcttctgatttaattccattttgtttgtcattcatattgagtatcctcaaaatgttcactctcagatctctctagttccaccctacacattttagttgagggaaatcttccacatccatagctttccatttttacttataatcaaggcactccataaccttgacctttaatgaagcaaaatttcttaattctaaaacccacaatcaagtcaatctgaagatgtccaaaattatattaatctctctcacactctacttccctatttcatcctctacatagtataatacacattgatcctgcaagtagcttatcatgaggataatgctagacttactcagttcccttgacatccacatttaattggtgactaagttctataaatctctctctgtaaaaatttttaaactgtaaattccctactttggacaattatcatctctcacttgagttttttcaaaacctcctaaattattttcatctatctagattttccctcacttatcctgcaattggagatttctttctaaaacataagtatgatgatgccaccatcctggttaaaaatcaacaatatttcattaaatttaagacaaagggcaagctcttcagtttaacatataagactcttcatgatgtagtcactgctttcttgccaagcttcatctacttctcagttttttagcctacatatttattttcttttggtaattttacttgaaaaaggtataattcactcctccaactatgggttatacaatcattatcatcagtaaaatataaacttgtggatgggaaggatcataccttaatgtcttggtatctcaaggacttttagcacatgttatttagaacgagaataaaagggacacattttgaatgcggaaagaaagggaaaatgaatgaataaaatctataacctgttaacattaattcatttttatttaaaataaacagcacaaaaagattgaattcaaagtgtcacctagtttaaaataacctgtatatcttttgaaaacctgaatgattttggtgagatatttatttttgctgtcaattctcatagaaactaattgaaatctgtttcttcattgtttatcaataatgtaatagtgaactgaattatgagtatataaaataaactagtgattaagtaaattttgattatacataatgagtatatgaaagcagtgttaatttatggttattgtcacatgttctacaatcataaaattgttgttactggaggaacttggtttctgtgctctaaatgcatgctatgctagcagaatttttaaaatattgatggattggaggtattgtttttattatgacacagactattttgagcttttgagactattttgaattattcaaaaatattagtctccattgatattggatctgacaacataaaaccctctgtattttaaggagttccagatccattatcaatttgagctaatgggctaactctgtaatggaaaactttgactgtgccaaaattgactctaaaaaatgagatctgaatgtattcctattgaattgccatgatttaacttaatagaattcagtatttctgacaagttctaaatggaggcgtccaaaaggttactatcattattatctgggctttcacccagcatttaaactcacaaatcactgtcatgttttctgctaaattcagcattgattctggcctccacattattatttttttcttttggtatgtttatgtagcatgagagttaagagaagatagtattttatattatgtttagcatttatttagagagaaaaaatgcacttttagtttgagtctaacaacagaaaaacgttttaatacgtctacatctatatttacatttctgtcaacctctttttctaagtctcttcaaaaagaatcagcatttcctaaaagacacagatatatccaagaggccaatttctgagttgcatatacagaataacatagacgatagaacttttagcattacattttaaatgaaaatattttacaaagcatattttaaaatcataggtgagagtagctataggacaatatttttacaattagagagaggtaaaagcattctcaaggtttccatagatgtggtcaatgccacaaagctcttctgaggattttagaatcctaaaaccctctctctttcactctctctctctgtcgtgtgaggatgcagcaagaaggcaggcaagcctctgcaaactggtaagagagccctcaccagatacttcatctgctggcatctcatatcttggactttccagcctccagaactgtaagaaatcactatgcattgtttaagccaccccagtctatgatatggtgttaagccacccagtccatgatacagcctccagaactgtaagaaatcactatctgttgtttaagccacccagtctatgatattgtttaagtagcccaagaaaactaagacaagggaggcatcaatttactgttggatttcttgacctttttttcaccttactataattttatccagcttctttaaaaacttaggtctcagcatggcctttaattcctcctgaaaaccttccctgcatgctttgggattgtattggaaatcccttccttatatgttcccaaagcttcctttgttttattttagcatttatcatgctggggcataattgcctgtttatttgtctgccctcttcattagactatatgccctttatatacaggctgaggatctctaatatgaaaatctgaaatgctccaaaatccaaaacattttgagcactgccatgatgccacaagtgaaaaattctgcacgagtacttaatgcaaactttgtttcatgcacaaaattaattaatatattgcataaagttaccttcaggctatgtggataaggctaagtaaaggattaataaataattgtggaattaaaaataataatttaaataaatctgcaataaaataaatctagcaaattgtgctccatattattcccaagatacatttatatcaccccaaggcatacgtagatgagttgttacaattacatcaggacataatttcaaaatcctaacacctagtataaatcagcactgtgtcactgacaacactttgtattataccatgatttctcaaactaactaaagtatttgttccagaaacagaaaacttccatgtttcatcactttatcaagaaggtctgggattcaaccaaaaaaaaaatagaggtgaagggtagactatgattatcttaacaacattgctcaagtttaagagactaacacattgttcagtaagtaaatattgaggaagacaatataatcattcagaatggtgatctaaagtttttctacagaagaaatatcacaaactaaagtacctaaaaatgtgcgttgagaaataatagataaaagccagtatgagcacttttaaagtcaaaggcaggttttcttcaaaataggagagaataaaggtcagggaaaaaaatagctcatagttttattggtgagcaggtccggaaacctggtaatatgtgtttgtaaagataacatagacaataaataaatgagggaagaagataaattattcaaagaagaatttagaaaaggaagcataagataaattctttgaaaaacaacaataacattttagtcaaacatattttaagttaaataacataagtaatgtgcaaaaatgtattgcaaatatataaggaaaacactaacacccaaatagaaaataatgtaaagggcataacatgtctcactaaagaaaaaataagccaataaaagtataaatggtattcaacctctgcataaaacaaaattttaaaacaagctttaaaatgaatggtttttaatgagataccatttttctacaagcatagtggttaacttggaatatattattctgttgagaacgcagaaaaaaagacactcattcactattggttaaaacataaattatataaaatgacaataatacatcagtatttccaaaataatccatatactttgaggcacctataatcccagctactcaggaagctgaggcagaagaattgcttgaacttgggaggtggaggttgcagtgagcagagattgtgccactgcactccagcctgggtgacaatgagacactctgtcaaaaaaaaaattcatatactttgaaatagcaaattaaaaagtaaaagccagctttgtgaaaatactcagaactgtggccaaataatgtacatagggtgctcagggtaaatcagtgaaaaaaacagagatttctactattgtaaaaatgaagaagtttacattctattgggaaaaggggcatagacaatagacagtaaacaaaataaatatattaattatgtagaatgttagcagatgctaaactttatgaccacaacaatgtcaaagctgagcaatgtcagatcagttaacacagatggcttgtccgaagaggaacaagggtttgagcacctgcaatacaaaatgggattatcagtacatcagcacaggtaggcctcatttttaaaaaggttggataaggtgatagttatccgtactaattctgaaagaaaagaatcacagtgagagagatcaaccaatgaatgtaagggtcctaaagtgatgcatgtctggcatattcaaaaatgctaggcaaccagtgtggccagaacagagtagaagaagcttccttaaaactgaagccagagaaatataatgtgtgtggtgtgtctgtgtagattttgtgcagcaatacgaaaaccttactagtgagtaaaagttagctaagaacaatgaggaataagtaaaagtaataaagaataagctgaagaaggcagggcgtggtggctcaagcctgtaatcccaacactttgggaggccgaggcgggcagatcatgaggtcagaagttcaagaccagcctggccaacatggttaaacccgtgtctcctaaaaatacaaaaattagctgggcaaggtggcacgttcctataatcccagctacacaggaggctgagactggagaatctcttgaacctggacccaggaggcagaggttgcagtgaacagagatcatgccactgcactccagcctgggctacagagcgagactgttttaaaaaaaaaaaaaaaagaatgagttgaagaagagaaatgagctcgtgaagagtctggcagtgagatgtcctggtgtgtgagtgactcctaaagaaattcagtatagcatctgaaaacgagtgtggaaaggaaggggaatcagggtaaagagaatgggctgcaattaaagattatattggaagcttgaactatgaatgactttagaagccttatttaggaaagtaacaatattatctcatgggttttgaatagggaatgaaatggctaagttttaattttaggaataccatccctttaactacattgaataattaattgtaaaggagaaaacatagctaagatggaactgactccaaattgttgttggaatagttcaagcttcagataatgataagctgatgctgtggcagaagaaataaaaggcaattgaagaaacagaactgacaatacttgatgatgaactggatgcagaagacaaagagaaggaaagaggcacagtggctcctaggtttctaattgtggtatttaggtaggtggaagcattcaacactcaatataggaaatacaaagccattttaagaggaagaagaacaggatttcagttttggacactctaagtgggtcacagcttaacccattggaaatatcctgtaggcagttacatacacgtatatcatgtccaaaattatagaataaaaagcaaaagttctcctctttatagttgtcttatatttttaactaatcatttcacataccatttcttctcctaatatattctggaaatcaatgacagaatcaaaaacagattaagctttccataaaaatctctgatcaaataatctcttacacaaaaacttctaatgacttaccattttctctggaattaagtaaatcattctagcctatgaggggctcatactgccatgctcgatgtgctgaaataagctcttcaacgtactccttgcttatgacagagttatttgcatatactcaaatatacctacccatggtttatacatttccacattttttttagtgaaagtccacatcaccaaattgcatttattataaacctgctcattcttctacatctagcaaccttttccatgaagctaattctaatacaaaagttatcagtggtttctctcctgacaccccatgcttccattctgtagttttcataagctggtttgtgttattgttttaattaagtattttatatgtttctctaagttttaataacttgacataactctagcttttaatacatattttttaaataacaattgcaataagtagatagagcaacatatccactgaaaactcattaagtttgagcatttgaatgtcagctggaagagatggcatttatataaaaggctgtcagccttcaaaaaagaaagggtgggcatatcagagctaatggcttgttctgagattgagacactcaaatgagaagggaggacagagatcatatcttaactcatgaacaatgactgaaatggaaattaaaataactaggaaggtcaagaataaatgtcccgggacaataaatatgtttttaaacttgagtctgattctattcaatgttattaacaacatgttttctactttagtccctgatcatttttccagagtcagtagactgtaagaaacctacaaaggaaaacaattaagagagatcatcaatattataaatactggattaaatacctcatttggtaggatcctaatacaattagaaagtgtgtaaatagttcttgtaatataactagcatctttcaaacactatgtcatatgaattttgaaaattataattctacacattcagaaagccctaacctagtagttccattattcgaatgctagaatgtaaggcttagagtttaaataatgtttgtttcatggcagagaatagaacagaatcaccattgctatactgccttactagggactaacagttcagtaaaagctacatgaagcctacattttaaaaaggtgaagagagattctgtaaataggaaagcaaaacacattctggcattgacttattaagagacctacagaagaataattaaagccatgcactggcagaagagaatttggcatcaatggctgctgatatctctcatgaacaccaacaaggatgtatataccacgttttcttcctgtcaggaaacagagatttaaagaacctggatctcactgattcttctaatcttggtttcaaactagatatgaatctcattatatatggctcctttgcattttttcatgatttgggcgatggaaactaagaaggcaatggatgcagaatgaattaagaagataggatcaaacctaaaaaggactggtgagaagctgacatagtttggaaagaaatgagaactgatttcagttgtgactgaaagttgtggttagactagtgactggaggactgatgaatggaaaggaacgtgtactctgacatagcagctgaagctacaatgaaaggaaataatctggtatgttgacagatgatctagagtgaatagtgagatgaagacttttttggtggtatgtgtctgggacagactggctttcctctctcgctccataccacatgcacctattccctttcccttttgtaatctttttcttttccatgatgccacttatggcagagtcaaaggaacatagctttgaagtcagatccaggtatgaatttacctttgtctactaccaactgtaattttgagaggtttactctcagtctctgttttcctcatttataaaatggggatgacaaaatatctatttcagagggttgtattgaggataaactgaaatcctaaaagaaaaacaaacaaaaaaaacaaacaaaaacaaatgtagttgggtatgtgataggtgttcagtaaatgatcttggtgaggcttgttttcattttcctttcaattgccaatctgtttccttttggtcttgttaccagttatctgataaattaaactctgactccactattataaaaaacctggaaacgattaaaccagaaagaagacaaaggctgggtgtgagtttaaaggatttcagaaatttgctgatcttctgtgtgcttcaatgtcaggaattagaaggtaggcaggttcacaaacagtggcagcaccaacagtggcagggaaaggggcttcatgccctcaactcacaatatccacctgtccaattctttcatgtggactagaggtatattctcaacctcacgtaaagtgtagcttccaacactatgtatgcttccctcccctttcaagagattgatccccttaacatcctggagttgtcacagtttagaacaaaaaatgaaagaaagaaaaatagcaaaaagactttccacagcaagacatctgggggactatcaataaatgtaatatagttgagacacctccaaaacgatttctgagcctctcccagccccgtggaaccagaatttctgaaagctgtattgtttttttaaatttcaacttttgttttagatacagggggtacatgtgcaggtttgttacattggaatatttcatggtgctaaggcttggaatatgaatcccgtcacccaggtagtgagcacaatacctataggtagttttcaacccgcccctcttcctccctctaccctctagtccacagggcctattgtttgcacatttatgttcatgtgtgctcaatatttagctcccacttgtaagtgagaacatgtagtatttgtttttccattcctgtgttaatttgcttagaattatagcctccagccccaactatgttgctgcaaaacatatgatttcatttcttttaaatggcaatatagtattctatggtgtatatgtaccacattttccttattcagtctaacattgatgtgcataagggttgattccatgtctttgctattgtaaatagcacagcaatgaacatacgagtgcatctgtctttttggtacaataatttattttctttggggtatatacccagcggtgggatagctgagttgaatggtagctctgttttaaggtctttgaggaatctgcagattgctttccacagtggctggactaatttacattcccaccaataatgtataagcgctaccctttttccatagctttgccagcatcttttgttttctgactttctaataatagccattctgactggtgtgatatctcacacagtattctgagtggtattcattgtggtcttgacttgcatttctctcatgattagtgatgttgaattttttttcatgtgtgttggcgacttgtacatcttcttttgagaagttcatgtagtttgcccatttttaaaatggggttatttgatttttgcttgttgatttgtttaagttccctgtagattctggatattaaggctttgtcggatgcatagtttcgaatatgttctcccattctgaaggttgtctgtttactttgttgacggcttcttttgttgttcagaagctctttagtttaattaggtcccacttgtttatttttgcttttgctgcagttgttttgggggcttagccaaagattatttgccaagctgatgttgagaagagtacttcctaggttttctgccatgatttttgtagtgtgaagtcttatatttaaatctttaatccattttgagttaatttctgtatatgatgaaaggtaggagtccagcttcaattttctgcatatggctagccagttatcctagcactatatactgaatggggagtcttttctcattgcttatttttgttggccttgttgaaaatcagacgtttgtaggtgtgcaactttatttccaagttttcgattctgttctgttggtctatgtgcctgtttttgtaccaatatcaaactcatttggttattgtggctttaaaatatagtttgaaattgggtagtgtgatgcctctggctttgttctttctgcttagggtagtgaaagctgtattttaaacaaatccccattacatttttctgcaaaataaagactctaaaaacttggccaggctcagtggctcatgcctgtaatcccatcactttgggaggctgaggcgggcagatcacaaggtcaggagattgagaccatcctggctaacacggtgaaacctgcttctactaaaaaaaatacaaaaaaattagccaggcgtggtgataggtgcctgtagtcccagctacttggaggctggggcagcagaatggtgtgaacccgggaggtggagcttgcagtaagccaagattgtgccactgcactccagcctgggcaacagagcaagacgccatcttaaaaaaaaaaatccgtctaaatataaacagaattacttcattggacttccagggaagccctttggtgcagacatgactcaaagagggggtccccttgccctccccctctcttccttttaaaatgagaatgtgacagtgaggtcatcggcagttatcttgtgagtataataaacttgatgcctccacagtctaagactagtggagctgagaataagtaagtttattctgctcctgatgacctcggacattccacataacccctggactctagatgttatcttaggtctctaacaacagtagctaaacctaatcctaattgacacagtgcttatacttttattaagttattaattttaaaaaagacatcagaaagtgttcaaagtcaatgtgaatgtcagtgtttggtccagaactgagtactgattttgtgcatgagctcacattcatggggtgggtggaagcatgcttggcacagaaatctttagaaagaaaagcagctctgaaggccggaacacctgtgatatatagggcacaggtggtaatttggcaactgtaagcctggccttttgagctgtggccaaaactaaatttggataaactcattatccatacatatgccctaatttcctgatagatttcagtcagatgtggtaattttctgctcagcttccttatgttatcacttattacatttgctaatgggggcggaaaaactgttctaggagaatatccaaaagcaattgattggtttgtattataatgtaggcgctaaaagaattagtttatttcaaataagtgacgacttgatgccttgtaaatatcttccacacatgcctcattttagttcttcctactaaggcatatgactatcaacactgttaaactttgcatgtaaaccatgttcctttcctctccatctcctcattcttctgaatgtctccactctttcaggtacataaaaattttttagaaattacccccaaaatgtgaaagtacaaaaaatggaagcaaacttaaattttcctcttattaaaaattatgactaaacaataaaacaaaacagttttttcatctcatctgcataattacacataatttctattttatgaattcccaacacttacgcagaagggaaatactcatggcttataatttatactttcataaaagtgatatgtttctttttttccaaagaatcaaagagttaatatattcactacttgtaaaaaaaatacaactcaggattagaaaagaggaaagttgtcaaaagatagtacgatcgttcttagccttgcatagtagaaaagatccaagggttcaaaaccaagtattgttaaggcatgatgttatattctcatgtggtgtgcagggggtgaaggtcactaaagaagcatcaacagatggtatcagcaatgataactacatgttttcagaagtaggttcaggaaattatcctcctacatggagattagttaggccccatagttaggccaagctaagtgacaataatacaagtagctaccatatgagtgtttaccattgtatttgagttatgcactatcagtatattaattcacaagttagaaaatgaggcttacagaatttgagtaaattgctcaggacctcacatactaagtgatgcatgtaaggttcacatccatgcagtctgactttggagatcatgttctaggcttcacaaaatattttctctatttggcatgtaagacattcttcttgttgaaagccatatcaagactgggagaaaggtgtttatgtcatccagaatgtctgactagtctcccatacaagattttgcgataggaggaatcatagctattgattaattggtaagtgcttatatttatatccactgtcaaagcctcaaaggttgtggaaattaggtaacttgtcaaattgtaccatactggaagaaatagagctagattttaaattcattctattacaaaaaccttgttttttacccaacatgacatggataaagaactactattctcctactaaacatataaagagtaactattgcacatgatattaaatatactctcatggggtgtattcagaaacatacatcatcaatttttgttgcactggctacatcttcatccttcatgtggccatcacgttctattaatgatgatttttaaagaagtttcaaaataaattttaaagtcatgcaatagaattaatagcaaagctactttaaaatataacaatgtactaacaaacaaatgatgaaaaactatcttcatagctcatcaaaatctttaaagtataatttgttaaatattttaggaatattgtacaagtataatatcacaagaaaagatattgtaagggaatacacctaagtctatgtatgcaattaaatattcatgaacttttataatcagaagataattcatataaatcttcaaatatgaagtcaataatagtaactgaccaaaccaaaccatctatgttaggtggtaaattagatgttcacaattatcacagttgtcctaaatacagtctctactgcctaattttcacaagtgtctcttctatgtttccattggtgtttcctgtaagtcgtcagatgttttacatcctctttagcagtaattgtttcttacttccttaagcagtataattgtaaaggatacagcaaaactttgaacagtcctctgtacctaatgccaaaacaatctgaaacagaaatgtcagtattttaacaactttaggtcattaatcacagtctattcaatagtaattttcattgctgaaaaatgtttttgattaatatacttaaactgaaaatcttgttcataatatcagacagatatttaagaatttgaaaatgatgagcacataaattttgctgtactcttcatttggtaactatataggaagaataaaagttttcctaaaaatatttcttgttcaatataaagtatatttttgagagcggcattgtacatttaaaaggttagtaggatgatggaaattgtgcagtcagctctatgtattctgttggttagagcaatgcatggtggcccaatcactatttttaatatatctaggccatttcaaaattaaaaggcatatactgtcagagttttgcccctgtgtgcacttcacaaacatgaaaatccactgtcatagggtgacttttcaaagacatatgtgcacatatgagggcattttctgatttttttccaattgagaaattatacaaaataatgtaagttcatgttccaatgtctatggctttaatattttgcattttcaaaataatgcaagaacagtattatgaagtagtatgttacacacaacaaggtttgaagaaaatttagtaaaacttagtcaagttacttctttcaaaaatcttgaaagtctgaattaagtaaatgtgtagccagatctcatttgctgagcgacagagaagaaacagaagggtttcgatctaaaaatattgatttgatatctcctctttttaaatgataaaacacaatggattttcatacttatgagaagttgaactacactgtgaatatagtaatcttgactagagagtatacaacgtgtattaaatgtgaatcatttaaatttggatgaatacatatgcaacctaatactaacatctgcccttattccttgttcaagtcttggctcaaattttacattctcattgaggtcttccttgaccacctggtttattattgcaaactaccttctcccaacactaccccaacgacctgtccctacacttataattctcttatgcttcttttaattttttacataaaattaaaaattgatttcatgaaattatgtaatttacttttgattatgcttatttctgtgtgcctctgctaaaatataaacttcagaagaatggggaacttagacactgaaaggcatttagtagctcaataagtacttgttaaaagactaataatattggcattgaggaaaaactgatgaaaatacttaatttctccatatctcaataatttatatcaaacagcagggactgtttatattctgttgttatataaaaataacaccagtcagttgtgctttcattgaattccatataatattgctttaaaagatatacggcattttcgtattttcataaaatatattgaaatgctctaaagagctgccagagttcataaaaaacaatcttgcaaactggctatagtacttggaaaagtggaagcaattcagaaacttcaaaggttgcagtcctactgagaaagatgtagtaagttagagaatattggagaaagcatagataactatttaactatatgataaataatttcacagccactgctgttcctccagccattcctattcttcatgttttggtatttatatttagtttatattttatactaggtgttttgaccacaattgtgtcaagaaactgaggaaacacacatcttcaaagctcacctgaagggcactgcagtttgtgttatgaaaggcttttgccttaaagccttgattttacaattcactgaataaaacagttgctgaatgcctgccacaaatcttgtcccgaaatatgaaagtctggcatgtactcaatgtacctgactctcagacaggtaaggcctcaagaaattcctgagcagggaatcgttaacttggagttcagaagagttgggtgttggacacaggcttcagagaaggcaaaatatttaatctgagttacatttggagtaggatttctaagcgaagatgccagaggtatagcaagaaattgcagaaatgcaaagttttgttgcattttggggagaattaatagttttctgtgttgggaagctagggcatgtaggacaactataaacattgtgcctgaaaagataacttggggttaagagccttgaaactcatggctagcatttaacttttattctgggaccaatagtggggaatccctgaagcaatttaacaataaaataaaaatgtatttaaatcaattccagaataaaagtgtttttctgttaataagaagcttgaaaagtacacaagaaccatggctggagtggattggtgattcttcagaaattccatgcatctcccacactctaattcatgacaataaagtgctctctgtttccaccatgattaaagctgtggtcaaactgaaccttagcttctcgttagccagatccttaggcaaccagcttcagtttctccagtaaaggcaccaaagtatttagcatggtcagcttataacgagtcaatctatgatgagccaggcattgtctaggtgaagtgttctccaagatgtggttcctggtctatagaagcttcacattctaactttagagacagccagtgaaggtacgaagtagtaggcaatgtgatataggctaccatagtgggtgctatgacaaaacatgacaaacaactaacctagtccatctggggctgacaattagggatgtcaggtttagcaaatacaaatatagttcattcaattagcgtttcagataaacagtgaataattttttagtatgagtatgccccaaatactcaaattttactgggcattctgtattttacttggcaaacctactgacaatactttttggataagacattgctggagcagcatctttacgtatagaaattaaccaggtgaaacatgttaaaaagaaaatttcaaacacagggaacaacatgtgcaaaatatgaagcaggggagaaaatagctcatttggaaaactgcaaggaaattcactataactaggtcatagaatgccaacagtgcaatacagatacatttgcaggttagtcaggagtcagatcatgatgagattggattgttttcctgaaagaaacagataccaaaggtcttgctgatagattcgctataaatttgtgtttttccaaaactgttggtccttcattgatgcctgacaaatttatgggttttgctttctttacataaatgtaatggtattatttattttctccagttatttcaaacatttgtgttatcttccagcctccttgtcccttcctctttctgagcattcttaccaaactgcttctttcttcccagaaatagataaaatgtgatgccacaattcccagtcaacccttacccattaactctcctccagttcacacctaccacttctgctgctgacgtaatcataaatattaaagtgtttgaccaacttttcttatgattcttactcttttcttggtcttatttcacattgcatgcctgtatcaaaacatctcatgtgccacataaatatacatacctaccatgtactcacaatttttttaaataaaaaacttaaataaagatgagtctcccctttcttccaactttcatacatgtataattcctcaatttttgctccagaatagaaaccatcctttcctaagtacccttgacctttctataccaatcatcctttgcctagctcattttatccacttcttcctctcaactggccctatattccaggcaggagcatgttcaaggctcttccatcttaaaccaaaaactttccctcaaattgcccaccttaaccatacatcagttttcctatctttatgaatctacccttgctatataaacactttctctccttaagtcactaaggcttggcttctgcctcctccatttatctaaaccatcttgcagcaaagtaataagcgaatcacactcggaatctgtatatgaaaattaaatattaacatgtattgccctagaactctacaatattaggatatacatattttggaaataaattttatattctgttattcccagcaacatatacaagctaactcatacttggtaagtcttacgtcaagctttatccaaaatcagcatcaaattttccctttaaagtctcacaatgtttctacaattggtgtccatactccaacaaacacataacactctgtgagtatatcataattatgatatcagttgaaacattaaaaaaaacaaatttgaaatttgagcaggtaggggcctttaacttaccttgtgcgctcaagtattcacactgtccaaacctttgccactttttcatagacttgctagttacttattaagagacttcataaattgctcaacctctttgaacttttttgatttcctgtatgcctcattcatttgtttacttacttattctgccagtagtttatgggtgtgctttgtatttagacatgtgctatgctataggacattttcagttgaataacgtaattccaacacttcgtgtcctttattttagctggaaaaattaatggattattgtgaagagtgaatgagaaaaataatatgtgcaagcaagttacagaataaaattccaggtcttgaggaaattatgcagggcctctataagaaggtaaggaagtggtgaaagctaggctggggttctctatttttcatgaattcaagatctgacatggtgtattcctaaatgattaataagtactacctatatataaatgtcatgttaacacttatgaaattttatcagaacatggaaatacataaccaagtataacaaaccaagacaaacacttcatttgtccaacctcatctaaaaattttagataatcactgaatttctaggcacctttatcatgcttcacaagcagcagattaagctaacacacatcatatgtcatgagtgttacaccagctactcctacatcatgtctagctatcatatccagcattttactacaaatcatttcttagaagaaacccttcagtacaggcagaataagcactagagatgcactagaggcagggagccatttttaccctcccaaaacccactctctctctcaccaaaactctgtgtatgtgtgtgtgtgtgtgtgtgtgtgtgagagagagaggataggtgtgacaaataagctaaatcaagctttgagaggatcttagacttctttaaatgaatatatatatatatatatatatatatatataaaatttgaagtaaaatcttcttttcttatccatgctcgtcaaagttctttgctaaaactgtgtgagacagtggcgttaccagcaacagtttttttgttttttttttttttttttgagacaagagccttgctctgtcgcccaggctggcactcactgcaacctccacctccccggttcaagtgattctcctgtctcagcctccaagtaactggggctacaggctcgccccatcaagcctggctaatattttgtatttttagtacagacaaggtttcaccatgttgcccaggctggtcttgaactcccggcctcaggtgatccaccagcctcagcctcccaaagtgctgggatcacaggtgtgagtgttacattacattttaacacatttctttttaagatgtaagtacttgttatcatacctttattttgttttttgttcttagaaaaactctttgaggcatgagaagaaactagagtatggaaagcttagaaaagtctgtggattggtcaagctgggaccttcatacaatttaatataacttttagtccaggataactcataaaatgtcctggaagtgaactgtaaaatatagagagaatcattctttcttataatgcagtatatattaattgtagactatttctcatacaaattcttgtaaaatattttactaggcacaccttataaatatactgagactaaatatgagtttagtctcaaaaactactgagtttttgcagctcaactgattctggatttttaactatttatttattttgcataattgaatgacaaatctgcaatgacatatgtatatatagatatatatattcacaaaacacaaacatatatataaatttcagtcaccaagaataaagaaataatgaggcgtcacgatcatctgaaaacttatcttatactctaacaaaaaataaatcgagttaaatataattttctaatgtctccaagtccatgatttttcctcattaatgtaatagttttatatattccttttacataaatgaatgtttttacactaaaatatctatgttttgtgaaaatttataaggaattgcaattttaagttcctttttgtgtctatgtttctacttttattagaatatatttaccaatgtatttcaattgtgtttctttttttttagcttttatttttttttatttattattattatactttaagttttagggtacatgtgcacaatgtgcaggttagttacatatgtatacatgtgccatgctggtgcgctgcacccactaactcgtcatctagcattaggtatatcccccaatgctatccctcccacctccccccaccccacaacagtccccagagtgtgatgttccccttcctgtgtccatgagttctcattgttcaattcccacctatgagtgagaatatgcggtgtttggttttttgttcttgcgatagtttactgagaatgatgatttccaatttcatccatgtccctacaaaggacatgaactcatcattttttatggctgcgtagtattccatggtgtatatgtttcacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggttaaatggtatttccagttctagatccctgaggaatcgccacactgacttccacaatggttgaactagtttacagtcccaccaacaatgtaaaagtgttcctatttctccacatcctctccagcacctgttgtttcctgacttttgaatgattgccattctaactggtatgagatggtatctcactgtggttttgatttgcatttctctgatggccagtgatggtgagcatttttcatgtgttttttggctgcataaatgtcttcttttgagaagtgtctgttcatgtccttcgcccactttttgatggggttgtttgtttttttcttgtaaatttgtttgagttcattgtagattctggatattagccctttgacagatgagtaggttgcgaaaattttctcccattttgtgggttgcctgttcactctgatggtagtttcttttgctgtgcagaagctcttgagtttaattagatcccatttgtcaattttggttttgttgccattgcttttggtgttttagacatgaagtccttgcccatgcctatgtcctgaatggtaatgcctaggttttcttctagggtttttatggttttaggtctaacgtttaagtctttactccatcttgaattaatttttgtctaaggtgtaaggaagggatccagtttcagctttctacatatggctagccagttttctcagcaccatttattaaatagggaattctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgagggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcacgtcgtctgcaaagagggacaatttgacttcctcttttcctaattgaatacactttatttccttctcctaactgattgccctggccagaacttccaacactatgttgaataggagtggtgagagaggtcatccctgtcttgtgccagttttcaaagggaatgcttccagtttttgcccattcactatgatattggctgtgggtttgtcatagatagctcttattattttgaaatacgtcccatgaatacctaatttattgagagtttttagcatgaagggttgttgaattttgtcaaaggcattttctgcatctattgagataatcatgtggttttggtctttggttctgtttatatgctggattacatttattgatttgcgtatattgaaccagccttgcatcccagggatgaagcccacttgatcatggtggataagctttttgatgtgctgctggattcggtttgctagtattttactgaggatttttgcatcaatgttcatcaaggatattggtctaaaattctcttttttggttgtgtctctgcacggctttggtatcagaatgatgctggcctcataaaatgagttagggaggattccctctttttctattgattggaatagtttcagaaggaatggtaccagttcctccttgtacctgtggtagaatttggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgaaatagtttcagaaggaatggtagcagttcctccttgtaccactggtagaagttggctgtgaatccatctggtcctggactctttttggttggtaagctattgtatttctgtgggatcggtggtgatatcccctttaccattttttattgcgtctatttgatacttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgttgctcttgcttttctagttcttctaatcgtgatgttagggtgtaaattttggatctttcctgctttctcttgtgggcatttagtgcataaatttccctctacacactgctttgaatgtgtcccagagattctggtatactctgtctttgttctcattggtttcaaagaacatctttatttctgccttcatttctttatgtacccagtagtcattcaggagcaggttgttcagtttccatgtagttgagcggctttgagtgagattcttaatcctgagttctagtttgattgcactgtggtctgagagatagtttgttataatttctgttctttaaatttgctgaggagatctttacttccaagtatgtggtcaattttggaataagtgtggtgtggtgctgaaaaaaatgtatattctgttgatttgggatggagaattctgtagatgtctattaggtccacttggtgcagagctgagttcaattcctgggtatccttgttgactttctgtctcgttgatctgtctaatgttgacagtggggtgttaaagtctcccattattaatgtgtgggagtctaagattctttgcaggtcactcaggacttgctttatgaatctgggtgctcctgtattgggcgcatatatatttagcatagttagctcttcttgttgaattgatccctttaccattatgtaatggccttctttgtctcttttgatctttgttggtttaaagtctgttttatcacagactaggattgcaacccctgcctttttttgttttccattggcttggtagaccttcctccatccttttattttgagcctatgtgtgtctctgcacgtgagatgggtttcctgaatacagcacactgatgggtcttgactctttatccaattcgccagtctgtgtcttttaattggagcatttagtacatttacatgaatttgcagcagctggtactggttgttcctttccatgtttagcacttccttcaggagctcttttagggcaggcctggtggtgacaaaatctctcagcatttgcttgtctgtaaaggattttatttctccttcacttatgaagcttagtgtggctggatatgaaattctgggttgaaaattcttttctttaagaatgttgaatattggcccccactctcttctggcttgtagagtttctgccgagagatccgctgttagtctgatgggcttccctttgagggtaaccggacctttctctctggctgcccttaacattttttccttcatttcaactttggtgaatctgacaattatgtgtcttggagttgctcttctcgaggagtatctttgtggcgttctctttagttcctgaatctgaatgttggcctgccttgctagactggggaagttctcctggataatgtcctgcagagtgttttccaacttggttccattctccccatcactttcaggtacaccaatcagatgtagatttggtcttttcacatagtcccatatttcttggaggctttgctcgtttctttttattcttttttctctaaacttcacttctcgcttcatttcattcatttcatgttccatcgctgatactgcttcttccagttcatcgcattggctcctgaggcttctgcattcttcatgtagttctcgagccttggttttcagctccatcagctcctttaagcacttctctgtattggttattctagttatacattcttctaacttttttcaaagttttcaacttctttgcctttggtttgaatctcctcccattgctcggagtaatttgatcgtctgaagccttcttctctcagctcgtcaaagtcattttccgtccagcttccttccgttgctggtgaggagctgcgttcctttggaggaggagaggtgctctgctttttagagtttccagtttttctgctgttttttccccatctttgtggttttatctacttttggtctttgatgatggtgatgtacagatgggtttttggtgtggatgtcctttgtgtttgttagttttccttctaacagacaggaccctcagctgcaggtctgttggagtacccggccgtgtgaggtgtcagtctgcccctgccgtgtggtgcctcccagttaggctgcttgggggtcaggggtcagggacccactttaggaggcagtctgcccattctcagatctccagctgcgtgctgggagaaccactactcttcttcaaagttgtcagacagggacatttaaggctgcagaggttactgctgtctttttttgtctgtgccctgcccccagaggtggagcctacagaggcaggcaggtctccttgagctgtggtgggctccacccagttcaggtttcctggctgctttgtttacctaagcaagcctgggcaatggtgggcacccctccccgagctttgctgccgccttgcagtttgatctcatattgctgtgctagtaatcagcaggactccatgcgcatgcacgtaggcccctccaagccacgtgcaggatataatctcctggtgcgccgttttttaagacggttggaaaagcgtagtattcgggtgggagtgacccgattttccaggtgccctctgtcacccctttctttgactaggaaagggaactccctgaccccttgcacttcccaagtgaggcaatgcctcgccctgcttcggctcgtgcacggtgcgtggacccactgacctgcgcccactgtctggcactccctagtgagatgaacccggtacctcagatggaaatgcagaaatcacccgtcttctgcgtcgcttacgctgggagctgtagactggagctgttcctttttggccatcttggctcctccccctgtgttttgattcaatatattactagcacagagcagagaaagcactcaatatatattgatttaagtaaaattaatgattggataaaatagcttcactgtcacactatacatgacactgacatatgtctatgtatatctctatgtcaggagacagaaatataacagtatttccacattctattcatagtagaaatgaaaggcttgaaaaacccaggtattttaattccaaattttgtttacttttagcatctatctcttcccagcctactctgttgataatttttactcagacctatacacataaaaatgctagcatatgcacatacacataaaacacacaaacacagtctgcattgtcatttataattttgaaataaattaaagattctagaagtaattataattttataatatacatgttatatagaatatgatattgacaaacatcttctcttgaaacaatgttatgcttattgggaaaattataccatggatgtttccagggacaacaatatagatgccatgactggtgacatttaaagaatttgggtaatttaaaaaaaataatttttcttattttaaaattaatattctagctaagacaggtagcctatgtccagccctggcaaaactctggagttcaggataaacagaaggttatgccattatctggtggattttgacagtacaaaatatcaatagcttaggtggaaaatttttgatgaattcatttggaataattttccaagatttttcaaactaagttgaaattacaaaatatggtttttaaaataaaatgtttatgaagaattcttatgtcctggtcatagaaacaagtgatacttatgaggcctaaaattagtggataatatgtggcatgcaaacatatgggtaaaggacttttggattagaggaataaatgttagatctggtagaactaattggtaaattatcaacttgttattttacaatatagtttaaataacccataatatctgtttaaaattggagtatatttctgcaataatttatctcatcttaacatacaacctaacccttatccgtcagcatggtgatataggtcacaaggtttgcaaaatcacacaaaaagttttaaaattaataactctggcatactatccttaattcattctgttaggggatgtaaatcattttatttgagaaaaaaataatgtctgttgataattttctggaggctaactcacatttttgcatgttaattctcagcaaggaagtttctccccaatttactaaaatttctagtgacattttttctagagtttaacaaaattcacatcaacaaatgtgtcacttcttttgacaaacttttatcctatttatctcattctttatcctaggagttactgtgacataaaataaaatgctaacagagcaagtaaaatatcagggatgaatgactagtaacattatacaaggtttgataagccgactcaaacttgaagaggtggcagctcaaataataactgactgggcagcagaaacaaaatgattacagtcttccaaagggcaatatctactttcagggagaaaatgtgctaaacaatcctgattctaccatattatacttgagagaaaataatattttatttatcattatatctccagggcttaggacagaggcaatgttcaaaaaataattttaaaaagctttattttgaaaagctaatagctaatttaatgctatcttaatgttacatttattttcctaagaataagacattaaagtacctgaaaattcaaatttttgtttcttctgaaacaaatttcactttttttttgtttgttttgttttttgagacggagtcttgctcttgtcgcccaggctggagtgtagtggcgtgacctcggctcactgcaacctctgcctcccatgttcaagctattctcctacctcagccccctgagtctgagtagctgggactacaggcacccgccaccacgcccggttaatttttgtacttttagtagagacagcgtttgaccatgttggccaggctaatctcaaactcctgacccgggagatccgcacgcctcggcctcccaaagtgctaggattacaggcacgagccactgtgcccagccacaaatttcacattttttaaagcatagagttatgatatgccccatatgcctagcctttgattatgtgctcctttaccccatttcctaacgatttcattattggaattgtcccctcaaccagattttaaatttcagagtagatacagcgttttattagactcttcttctccatgttgtttggccaggtggggtgcatgtaatttagtttagatacattaggaacttaaaatagcaatatattgtttgtattattttaataataatgtcaatctcaggacaactgtacaaaagataccatatcctttagtgtttactagtcacagtcagagtattatttggataacttcttcaaggttcagaaggatatagcctcacaaattaaaatccaaatgcatagaaaagaattttatgacatctatactttatccttaacaatgacaaaatgaagccgggtgtcgtggctcacatctataatcccagcactttgggaggccgaggcgggcggatcatctgaggtcaggagttccagaccagcctgatcaacatggtgaaaccccatctctactaaaaaaaaaaaacaaaacaacaaaaaaatagccagccgtggtggtgcacacctgtaatcccagctactcgggaggctgaggcaggagaatggtcataaataaatgtaaagaggttcaatatacctaaaaatcaagaaatacgaattccaactattgggatccactattatttcatgattaaactatcttggctaaaatattgactctgccactcactagccatgtacaagttatttaatatttctggccttcatttttcctttttttcttctttatattagataaatgataactataattcacaataaaaatggaaagaactttagttactcagagtaataatagcagctacctaataaaaatatttgtaaataaaataaaattgtgcttctaaattgtctaaatgaaggcctggtatgtactaatcactcaacaaatgttagctattaataatgataaatcattccacggctatgagattaacaataataataatagtttaaaaagtaaagcaaacacaaaagaatgttgactgaagaggaattttaacgtcctgcattgaggaaaacttcgcatttttaaagtagaaattgtcaaaatatgtataagcatttatattacagtattgtttatatctattaaaaattagaaacaacactatgttggtatatacatgttataaaatacaacacaatagttaaagtgaataaacaaataaattaatgggaagactcatgcatttatctctcctttcttatatgaaacttattgtaggataacaaagtattttataaaatgttaggtaggaaggagcacgtgaatcagaatatcactgttttgcaacctttaataaaataataaatgttggtcgtggctgcaaacatcacagatagggcaacattctgatgtaagtacacaacaccacctatgatatagtcttgccaaaaaacaaccctgaatttcactactagtttataggaaataaaggggaaaaaggaacattttgaagttagcaaactccagatctcgagaaactctaaaggcaaatgagtaggtatctctaacgaataaatagctagggaagaagagaaaaagaaagaaacagagacacagagagacagagattgcttttagttctagatttagcttaaaatgtatttaaaatgtatctttaattctaattagaaaaaagctttaaattttttgaagaaagacaatccaaaaatttttaacattgagtatttgatgaaaataaataaatattcttaattattttgtgaacaataatatttttatatgttttaaatcctattatttttacagttatatattcaaacatttcataattaaattatattctatttgtgattatctttataaccatatggggcggtgagtttttatatggatgaaacaagaatacttaagcattgaaaattattattcccccctccccccacgccaacacaaattccctccacccccttaaccctgccccaggcggagtttcatgcttgttgcccaggctggaatactatggtgccatctcggctcactgcaacctccacctcccaggttcaggcgattctcctgcattagcctcccaagtagctgcaattacatgtgtgcaccaccacacccagctaatttttgtatttttagtagagacagggtttcaccatgttggtcagactggtcttgaactcctgacctcatgtgatccacccacccagcctccaaaagtgctaggattgcaggcatgagccaccatgccaggaccacattttattattattcttcttcttattattatacattaagttctagggtacatgtgcacaatgtgcaggtttgttacatatgtatacatgtgccatgttggtgtgctgcatccattaactcgtcatttacattaggtatatctcctaatgctttccctcccctctcccctcaccccacaacaggccccggtgtgtgatgttccccttcctgtgtccaagtgttctcattgttcaattcccacctatgagtgagaacattcggtgtttggttttttgttcttgcgatagtttgctgagaatgatggtttccagctcatccatgtccctacaaaggacatgaactcatccttttttttggctgcatagtattccatggtgtatatgtgccacattttcttaatccagtctattgttgatggacatttgggttggtgccaagtctttgctactgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgactttttaatgattgtcattccaattggtgtgagatggtatctcattgtggttttgatttgcatttctctgatggccagtgatgataagcattttttcatgtgtctgttggctgcataaatgtcttcttttgagaagtgtctgttcatatccttcgcccactttttgatggggttgtttgtttttttcttgtaaatttgtttgagttcattgtagattctggatattagccctttgacagatgagtagattgcaaaaattttctcccattctgtaggttgcctgttcactctgatggtagtttcttttgctgtgtagaagctctttagttttaattagattccgtttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaagaaagggatccagtttcagctttctacatatggctagccagttttcccagcaccatttattaaatagggaatcctttccccattgcttgtttttctcaggtttgtcaaagatcagatggttgtagatgtgtggtattatttctgagggctctgctcctttccattggtctatatctctgttttggtaccagtaacatgccgttttggttgctgtagccttgtagtatagtttgaagtcaggtagcgtgatgcctcccgctttgttcttttggcttaggattgacttggcaaaggaattgaaaattattgaagctggagaagggtaaattataacattctatttttgaagacattttaaggttttcattaaaatctggatgcatatatatttagttaaaaaatgaaaatgccaactagaaaagcacacatatggaagcttagtttattaatatttttcatatataaatatacatgcatataggtatatgtaaatatataaatacacacacatccatgttggaggctattcataatatttttatcatattcaaatactggtattatttttcatcagtctaatatgactctggacacctatcagaaataaggaacattagctaatcaagcttgcctcaatatgttattatcctgacataataaaggtatcattatatcttggtaagttcaaatgtaaataattcaaagtgcaatcttgcttgccttctccttgctgatgtaacaaggatagtatagttatgttcactagaatgaaataaaatcggcatttcttctttatattagataaatgataactgtaattcacaataaaaattaaaagaactttagttacagattacatttatctgctaaaatatatctcaaacttagattgtaaaatgatcatttttcttgtttaagacccaagaaacatttcagaaattaattatggtattgtcatgcttcaagtgcatatgttcttaagacaacttacatgctttaccctgggagtctatgaacaaccacattttcttatctgtcagctaaatcagagacaccatctaccagatgactcataccagcaatttagaaaataaaatccacctcaaatttggtcttcaatttaaaatttcttgaaagtgtaatgttacctcatcaaaatattaaataacaactgaccacattattccatgtctgtacctctgttttctaggattttttaatttaataaaaaatttaaaaatgcaaaacacaaatgcaaactgggttacaaaataaaaataaaaaatgaaaaacacaaatgcaaactgggttcatcaataagagaggaaattaccactcggatgtatttcttaattttttattttgctttgtattgctatttttattcatgactaggaaaggctttaaagcctctccttcaggaaaaattgtttgcctaaaagtacagctctgtatggagatctgaattttattactaaatcatttgttattctttttattcatttgatattaatcttgattattgtatcataaaagctcactgagaataggaaattcatgttaattctaaagaaacatcattaatatatttataacaaaaatgttatgcatttagtggcctcaaacctgcatactaaaagtgacatttcttaatggaaagaaaaattccactgtcaccagcaacagtaaagagatatattgtatactgttaataataagaattcacagggccattagttgaaagactagagggatagaatacaatatcaatttgtagaaggaatgtttcacagcaagtcaattagaacagaaattatgtcacaaagcttgttttttaatagcatatagatattagcatgttttacatatgttttttaaactaggtaggaaatttagatttcccattaacatggacaacaatcctgtgaacgactgctcagcttatgtggtactccatagtctctgcccttttccttccctttccatcttgcctatctattggagaggaacacagccaagttccaattcatcactgctatacacagtttccatgcaatgctgccactggcaccaactccctccatctggccttagtctgagcatggtttcctctacaactgttgccagtctgttgccatagcagcagctaagaggactatgacaggatgggaaaagaataaagcacactccattttcatgcttcttgttgagattttgtaatggttccaaggtcccactaaaactatgatggaaaaaataaaaacagcttcaccaaagatacaataaacatccttttcaaagagaaataacagtatataaatgagaaacattgaagcctgcaaattgagaataaaggagcacacacacatggtcagaaggtgacccacggattacacgaatatcaaattatgaaaataataaaggataatttttaggtctttgttaatgaaagattagaaagacaagctataaacaaacatgttagatcagtgtttggaaattcttattaatgaaaaatctgcagtaattccttaaatagctacatcaatatttgaataaatataaaggtaagcattttctaggtagtttattataattccatgataaaaatcattacctatgtttctgacttaaagagacatataacattatatgtgtgcaggaaaatacatcttatctgaatttcaccaaaaacttattttaattctataaattctgaagattatcatatatatacacaaatattgtctacaaaaaggcaacttaccataaacaaaagcactgaaaattaaaggacaataaaaatcaatgaattctaatcttaagcttaaaagcctactgtgaaagcttttggcaaatagaaatattactaactcttaaggttcatgtgatgaatattgaattggaaatgtatgtgaaaagttcatcatatttttctccattctccaagtacgattacagaaaattcccaaaggccactgtatcttacttttgaaaccataaggagttagattacaccacctgttttacaatccaggctatcctcaatgttcacaattttcacctgtttgtaactgaaaaccaaaaggagttagattacaccacctgttttacaatccatgctaggctcaatgttcacaattttcacctgtttataattaaagctcatggtgagcttcagctcaccaacatttcctcaaatatttagtattatctctgcttctatactcaaacattaggcactgtcttttctgggaaaaaaatagggaaagaaaagacaaagggtatgtcctacttataatcatgccactgaaaagcttcaaaactcagggcactctcaatgaaaaaaactgacattttcaagcatctcatttcaagtcagacttttctatatagaatgtctgtgatgtaatatcaaccaataatataaagcttcctaataaaaaagattgttttaaatttatgatagatacatttgaaacagatgatgcaagtaggctatattgtattatttagtttgataaactaatagataaaaccacaaagttgtgcccaagggtttggcttccaggttgaaaccttgtgaaagccaaacaagctaagcctggtgaacaaatggttttcatcatcatttttattcgccataattcaatttatcctactattcagcctgcttgtaaaaaataccactattatagtcaagtctgcaaatatttactaagttcttaccctgcccaaagcacatgagtaaaataatgattttccttactttcaagtcctttaaacatgactgatacacaacatgcttccttctttgagcattacaaatgattactggtaaggttggtgtttaacatgtcagcattgtatcattttctgctaaatcgatcttgttcatttgtaactaggagtgcacctcatagcagagcggagagattgccacataatatctcagaggcgaaaataattcaagagattttgttgtgccagggagttagacacatttatgctctttgggttatgtagagctgtatgataaagtagatgatatgtctttataaacttacacatttaactatatatgctcacaggctgaggaggagagaaaaataaagggaaaaaaaagcatttgaatagtgcagaagacttcagtcaccaccacattctaagcctgcatgctgcaggttgagcatgaactgcactcatgaaagttcagattcttctcagtttctgtgttcctccaacagtaggagcatctcagtgggccatgtgtgattccagtgtttaaagataggacttcatttaaaatgctcccaaaattcaatccaattatgtcaactcattttcaactaggagagactgatatattctaatttgagaggagagacgggctacgttggagctattgacagatatagccagtatgtggctgttatgaatattttcaaggaattttttttcactataacaagatgcaatttagaatctaaagaatatcattgaaatacattttgttgtggaacaagtaattattcttcaggcctcacatggcctcgttcaaataccatccaggccatacagcaaagctgtgtttttgattccaaaaatcatcatggaaacttctgatcattaatctagatcccctgctacctgaataagtagaaggaattccccagatattagacactaaaattatcctctctcaaatggactatcatccatgtaaattaacaaaattgaattataccaaacacttcacatccgacatcattttggcaaataataataacacttgaatgaaaagacaacctgtcttcaagagcttatggtctatccaaaaaatggtatgacttgatatcagatggaaagtttgtaggaggttctccagaagcatatatgaaggagtgactaacaccatatacatacataagagaaaatttcccccaaaaggtaagtgttcagatgagtcttcctaaacaattatgagatttccatgcagataataagaagtgaagaacatttttttcagaaacatgaatgtgcgtatgacacaagaattgaattgagtgttcaggaacattctattatatgactagagtatcgactcaatagggctggggcttgttaacttgttcattttcaaattccctcctagctcctactatagagtccggctcacacagaatgcttaatcaatctttatttgattagaggtaagtgtctggaacacataatcatctgaagtgggtataccaaatatagtgagaattaggctggagtgtaatttgacaggaaatattaaatgaaaaatgattagaagagaaaattttactcctctctcgtttaagttttggcatcccagccctgttttgatgactaactgaagaatgaggacctgattctaccatgttgtcaaactgctctgtgttctgccatcatgtccacattccaggtgggcaaaagaagaaaggagtagaagaagggtatgtctcctccatttaagaacaaaaaaagttacttaatgatatctgttatatcccatcctcaatagctgtcacatctgactctagggaccttagaaatgttgagtttattgttggtgtccatatccagttaatatttagtggccctattaaagggaacaaaatacaaaataaacactgggggaaattagcaatctctttctcccattttaatggattttgaatttcatcatgtaggtaatatgatgtaagcagttacttaggttaatgataaatttttaactttataaaagttaataacacctccagtagcaatgagtatacccagtacctagatgatggtttctaatgccattctccatgagctctccatggccaaaaatgaaacaagttaagaaacaaaataaataatgtattattagaatataagccaaagtataaaataaatttccatgagtccattataatataaataaatgattgaatcaagagataaatggaataaaaatatcctgtgcagaagaattccaaataagttacgtaggtacactcccctaaggaagatggagtaaacttccaacccattaagtgtacgctgcatgtagtgacttccttccaagatacaatatggtaagtggagaaaaagataaacattatggtagataaatctgagaaacacaccctcagccagatgatgaaggttaacttcaatgatatgtaatattcagagaatgtacccttgatatgaatgtttaattagagaatggtatattacttctgtggcttttctcccaaagacttacaacccctttgtaacaatacaaaaatcagacaaacctaatttaatgacattttatataacagcttcttcaaactgtcaaggtcataaaaattaaggaaagtcagagaaaatgttagttaaaaggagcctaaggagacatgaggacttaatgtaatgtggtttttggttgggatcccagaagagaaagaggacgttagactaaaaaactaagcaatatgaataaaagtatgagcttcagttaaaaataatctatcagtattggttcgttagttcgtcagatgtatcagagtaagatgttaataaatagaagaaactatgcacagtatatgaaaactatatttacacatttttggcaaatataaaactattacaaattaaaagtttacttgaaaagttataatgctcaatgtaataagttctacaaaaggaagtagtatttagttcatggcccttaaagttaaggataagattattcatctttatataacttactaccatcctgtaaggctctgtgtgagcaactagccagcttttctagctggattccttctatcgtcactttctatttacaaaaccctattttaactctcataaatttgagaataaaagtatttcaatcacatttaattcattttacatattccactagtcaaaataattttttccaaaatgctatttgctaggaacactgtaatgtcttctgaaaacttagtgatcttgtcttctggaatatggtatggttaatgaagtctaaagtgctaaaaaataagttgaacagcacttatgtcagatgtaactcatctttttactttttttctagttgaggaattaactaatttcaggctcaaatattagaaagctggccccatagggctactttccagacctaactagttattaacagattagtatgtataaaaaatattttattggtaatcatctagtcaataatttaaatatagattacataatctacttttttctaagaaaataatttttaaaaaatcctgccccatgaatatttttatttatttatttgttgaattggcattctttaaaaaaatattactctagaggacaatgcccaggtcatggtgtggcactgaattccacagtagccacggttacattgttgaaaagattctacatgagcacactctgaatcatacagaggaattcagaagataagataaaatacaaaatgtgattagaaatactacccagttgtaccaacttaaagtaaagcaagcttgatttaccaaaatataaacaagtaaacctgatggaaatgaaaggcaaatatgaggtttttagatagagtgaagtaatatttaatagaaaaaaatctttatttatcaacgcccatttactaagttccaactcacgccagagcccgactttaaaaattaataaagtacatctccatattttaataatgtacagttctggtgaaatatggagacataaaaacacaacattataacataaagttgattatatttcgaagacacccatagggcgttaaggacacatatgcacaatacacatatggcaaaacccctagattttggcattaccagtaaacataaatacatcgagaaagtaactgaaatttaaattttgcaaaagaatagtgaatcaaatatattacctacgtctgttttagaaaagggaattatttatgataaaacaaaaggtaaaatcataatacatataactctgaagaagcctagaatgagagctcataggaaagttacatgatgttaaagaagaaggaggggtgcaggaaggtatgaaagaaatatgtaaaaaacacattttcctcatgataaattatagaatcaagataattcctacctacattaaggaaactccattcaaaggtataaaccatcaaagccagacaaagtagttatatagaccaggcctggactggcattggtccctggactgttaggaactgggttgcatggcctgtggtaagtggcaggtgagcaagcaccacctgagctctgcctcctgttagaacagcagtggcatgtgattctcacaggagcgttaaacctattgtgaactgcacttgcaaggaatctaggttgcacgttacccttatgagaatctaatgcttgattatctaaggtggaacagtttcatcctgaaaccattgccccacccctgactgtggaaaaattgttttccatgagaccagtccctggtgacaaaaaggttggggactgtggctatagccccattatctataaagcctcatagatttcagacccacattaaggtagatacatgaaatttagaaatttgcaagaatttccataatgataaacatttttaaaaggacataaactgtccaaatgtaaggggataccaagggacaagaagaaaacatcaagcactgatcaacctcttgttattttctttgctgataagttttcacctgctaatttttccctgaaagttataggatagaaactatacgtcaaagaaaggttaacagtgggaacatcctaagaccaatgggcagtcttagaatacattgaatgaaatttctcaaaatttcttctccttattttctgagtttaaaaaagccataacaatttatatatccatatatcctatgaattctgattgaaaacctaatgctattatttaacattattaggaaataatatccttatttttaaaagtctacctcaaacacattgcgctgtctttcctaatatttcattattgccacaatcatcccttatgtgaatcatgaaaataacctccaaagccgtctcttccaatatttctctgctctaatcccacaatctggctgtagccagacaatcttattaaaatactgactggatcatgtaattcaaaacctttaaggactactcttcaaataaaaattaagaccaaatttcttgccgagttcaaaacctggtacaaatagttccaattctatttttcaataattttacatttatttctacctcaatgtttaagcgttctttatccgaaaaccaaccttcccaaaatttgttcctgcttgttgatctgaccacactgaagtgatcttggcctcatcctgcctcagcttggaatttctactcatctctcagaatacacctacagaggaaaccttttcaataaagccatgaacagaatacacatttggcaaatgttcatgggattaatttgaaacctgtttagggtatttagtctacgaaactcatgacaaaaaacatccagactttacttgaatatttctgaactaatttactacttcatgaggcattcattgcaaatatttttttctttctgttgaattgaaatttgtcttctggaaatttcaatccttctatcctaaaaatcctgctttaatttgagtgtttttagatgtttttattaatttttattggtaatatgctttcttatttatttcttaattattatgataatttagagataagaactatacaactagatgtatgcctacaaaactttttcatgatatatagaccctatgtgcacagttttcattttaacatatcgaggacagaagaaaaatcacagctgatgttaaaatatgtgataactgctgctacacttctacatcagattctgagaagtccatcaagctgtaataggttttctttttttcttatagataaccaaattacttgcccaaagaagctctcattatcagaaggtatactataatacttaactacatagtatcaaactaggaaacctaaaaaacttagcgtttttacccaaaagcatcaataaagtcactgttgaaattgctgaactctcatttattcattcaacaattgcttactgaatatttgttgatgtcttagagaaacatgaacaaaatcatgtagcaataagtaccattcaattcaattcaaaatgtattacacttttattctatgcaaaccactgtcttaactaaagagataccaaatttatcttcatagttgttatcacataccaggaatgccaagtatataagttataacaggttggctcatgtacaaataaatagagtattcctgcaatgataccataagaaaatgaggctacaattctactaacgtcccacatagagagaatatagacacagttcacctgtccatccagctactttatacccaacctataaccacattatgaaacatcatatcttttcagattctaagaatgcctgctactggtttcatgacaaacatataaactttgaattgcaacttaaaaaaatgtcaaaattatcccacaggataaaataaaatataaacccatcaaaatgctgtattaaatctaccaccaaaaatgcctctttcttttcaggaaaaaatacaaaactgtgatccacagagaatgaccctttctgatatgtatacatgcatgtcaacttttaattcatgattctaaattgagaaacctcaaacagctatttttaatatcccagccctattcttattttgcatttatatccatcatatatctcaaccagtgttattgtttattgtatcattacacaaatacatagatcatttccatgtttgctcttttggaaggggtttcctcaatggagttgacttatcctccaaatttgacccattcttttaggcccagttcacatcttctctccttctagcccttacctccctgtttaaacattgaacacttttttctccttaaactactagagtacttgtattctggagtaaaacttttgaaatttgattaaatacagtgtaccatccatatccccagaagaacagtttatataaagtgatgtatattttaaaaagctaactttttaaagaaagaaataagaagtgatattttcttcttttgtttctctttttcttctagtcctttcagtagttctttggaatgcaaggataagatagacaatattcataaataaaacttcctccaattaaaatatgccataatttgaatttggcaaattagtttgtggtattagatatatttttgtaactctattggaaattattttcctggttttataaactgctctcaactttgtcaactccaggattaactgcatattgatccttagaatagtccaccatagaaaaatttgattaataagccaaagctaattgtgtctctgaatattttttattgtcttgaggattactgaagtctctcttatactttgtatttgatcagacttggtatcttattaaatattattagttcatactgtcttattacagccagagtccactatgcatttaaaattatgatgttcttcatatcatgtcccatatattatagatgttaacttattagttatctcattgaagtaaaaaaaattcttctgctaagtttctcaggataatattcaggagcagaagtctgcagactctagacacagttccttctttattgatttatgcataaagagaatcataggactttgtggaaaactgtgttaggaaaaaaattgtaagactgctttgagcctttattgacatattctgaaggctttgatttcataaatgctaacaagccataagtataagttgtgtgactttaatacagactcctggatattgatagttattaagaacctgcaccataattaaaccacgatagtcagaacagacaggaataatctctaatcagacacaatttctagtggggtaaaaatgggaatacattcatactactcccttatttttacttctttattaataaattgattctactttttggatgagtttgtttcatggcttcctttgatccccacgctatccccatcatacacacacatatgcatgtataaatattcatgcatacattcatattgtagaaaacaaaaagatattttcctacgtatacattatcacatagcctcaaatctgatcttctgtggcagagattgtattcccaatttccccttaaaaaaaaaaaaaaaaaaaaaaaacatgatttcactggggtcagaacattgccaagataaaaaagctgtatttcccacccatccttataaatagaaatgtccgtgtgatgtcagtcaaaatatcggctttgagcttccaaggaggttgactcaaatagtctataccctattaccattggttcttcatcttttcttctttttgaagaaaaaactacctgaattacagcaaagatcttgtaaaaataagaacaagaaccacaacctgaaaattgtggcaaagaaagctaaaaggacatgataatatccccaatgaaatgatgttgtccccataccagcttcttatggcctatctttgggcttctctttatttggaaaaaagcaaatcaaaaatcaatttttagccactgtaatataagttacttgctatatgtagtccactgcaattcctactaatacacctcctaaattttgtcagaaataagaatttcagataaatgaatgctaaaattgaagcaatcaattgtggttgatgacatttcacatttaactggctcacagctaaaaggtgcaaagtgtaagttaatttattgatttgcccagagtgatagactgaaacaactttatcttagaggatttaccgggaggttacatcacttcagattactgaaaccatagtctatgatgtacaacatttggcacatcaatcatttatttgcatcagagtagactctaaattgttgtgggcaaaatcttgactttgtttttgggcattccatggttccatatctaccaagcagtatgagaggcctctctttaaactcatgtctccatcagtctccccacattgttcaagatgtcagctcctgggcagaagcatggtggtgtggcagcctgatcacaggactggcaggatcatgctggctactaggaagaatctcctgatggcacagggatgactgggggtctgagtaagataagcagaaattggaataagataagcaggttatattgagagtgcaggaaacctaagatatgcacagcctgaggaggaggcccaacgacgtaaatactgtgaccctgatagaagagaccatttgatggacaatcccttcaggggctgaagagaatcaaaatggaatgtgaagaaagattaaaacaaatgaaaaattcatcctgggggtcatttttcatcagaaaacaacagaaagaatacagttagataatgaagttctttcagccagtaatttgttgaaaagagggaagggaatcttagcatatggggaccaaaaagtaaacctgaagaaattagaaaactctgtattactatccagaaaacaactgagtttcctaagctaagaaaaactttaaaaatgccttcatataagatctcagcagcccaaaggtactgatgtaaaaggtatttatatacatataaaatgtgcatatatatacataaatatataaaatttaaaacaaatatatataattttcacagagggccctaagaccattttggtagctgattgccagaacaaaaagagggccatcaaaatcaagttatgctagcataaattatggccatatatattaattataggaatcacaaccaattttattagaaggaatttaatgcttacatttgaacaacaacaacaacaaaaagtctggctactgggaaatgagaatctgagttttctcctcctaagtaatcaagataatgagaagatcacagaccactacaatgagaagttcaagaagatgatcaggtaacactgagagaagcttgtggatcctgaaaactgtgtttattgtttacattgataagtataggatatactctaaatcaaacacacaaacatacacacactgtcctttctagaggcctgctaattttttagtagataagtccgaaaagtaggccatagtagttctactttttacatgctgggatctgtgatattgaatttgtaatattttgagaaaaaaacaatgtgcagttttctcaaaatgacaagcagtgagtattgtgtttacttcccactaacatgttttccccctcagtcaacaaaaagaaatatatgtagggtgtgagattttatcacatcaatttttaaaaactatttattcaataatgtctttcattccaaatagcatgagattttgagtctcattattcatagaatctcattattcattgaaacctgtcttggaaaatctaagagggaccaaaaggaaaattttattttctgtcttttacaaacttgctgtattcattcattttaaaatgtatttttttttttaccattttagctcttatttgttaaacataaaataaacttaaccaggtagttaaaaatatttataggtgatttttacctaataattaggttggctttctataaaaacatgtgtttacccataagagttgacaacagttatctgcattcttagtacctgtaagacttgaattcattgccacaaaatactgatcaaaatcttagtggataaaaataatatttatgtataacatttatgaataaagatatgggcattaatcactatattatcaaaagtataagcagttcacatatgtgtgcttaggttggtccattctgtcacagtacctcatctatattgttttgcttagcctgctcccattggagtaatctttattgaacattatttgggcattactgcattggtcatatgagaatgtggcacaaaaagtcttaggaaactcatttttaattatctttaggagcatattgaaagcattgttcattgcatgacatgcttatctcttcatagggattaattggaaattaatatttgcatctgctccagtctcagtctttggaatatgtgtatatcacctagtaattggtttgtatttaacttatggacactgatttatgcaacttgtcttatttagccttcccattgtctgttacatagcacagaactgtatttgttatccacctagtgccagtacattgcaaattataatatttcatgtattaatcttattttcatgttcactttccctgaccctattatcttttgaatttctttacatattaattttaatattattctatgatgcttattttattaactatccaaagtttctcttttgtaaacaaggcagtatatagcagcatcttaaaaataaacattcatctatgcattcatttggtaagtatatattgaggacttacattatggcagagcctgtataaagtgctggttttacaatggagaataagcagcttcaaggaacttcttttagagatgaaaagacatactactcaggcaagtcattataatataatataagtgttatcacatgtacaatgtccagtagtagcataaaggataaacaagtctcttttagaagacagatgctgtatcagtcatggccctgccaagaaaagcacgtcatatgcaaaccagctactttcctaagaggtttttttttttgtttttttggctttttaaaaaattattttaaagggcctgggaaagatttagtaagagatgacatagatccttgaggcttgtaccatctgggagcccttgaacacttggacctgaagagacgaaaagagaggttcaggaatccaaagaagataaatatatagagagagcaccctaaaggagagtgaaaccaaccctctttgcaaagagggagccaagaaaacaaaggctctgaactcccttgcaaccttctcttcttctagcttctggcgcctcccattggccaaacttaacatgaagccacagagaaagtgtattagtttccaagggctatggtaccacagactagatagatttgaacaacagaaatttattgtatcacagttctggaggctagtagtctgaaatcaaggtatcagcaaggttggtttcttgtgaggtttgtgaggaaaaatctgttccatgcctttctcctacattctggtagcctcagaaattgcttggcttgtagatggcattatgtcttttcatatcatcttcccttctttcatctgtgtctttgtgtccaaatcaaatgcttttattaggataccagtcatgctggattagaacccatgccaatgacctcattttaacctgattacctctgttatgaccctatttccaaatagggtcgcatgctgaagtactaggattgagtacttcaccatatcttttgcagggaggggataaaattaacccataacagcaaggagttccagtaatgtggtctaaatattaaataacgttataatataacttattatcagcaaagatacagctccacagttttcactaatcattaatcagctatgttattaaataagggaattattatgtttggtagaataattttacagaacattagggtaaagacttccaatttaactaaaactcagaaggttttaagaatattctagagtcttacttgttatagatgagattgatttagtcagtttaaatcgttcttaaattttaaaacactataaactaaatgactttgcaattttattcaactgtatgtttctgtttcttacctaatagtcatgtatcttacctaataacctatagttagaaaccttgattttattccacttctttaaaatatagaaatttactttcttaacagtatttctaattttattcccctaagttgttaaaaaaagtcatgtatccagaattacttttgctgttattaccgtcagcttcattttaagctatacacttaaacttactgtgtaaataattaaatgtatgtggtcattttcataggttatagaaatgatcattaaaacctttgttcaaaatcaccatgtgaaaaactagtgtcagatttactgatttgaattaaattatgcattgagtttcaaacctgtgcaaaatgaaagcacagtatggccctcagcatcaatctcaacacacaaacattcatcagtactatacccctacaattacttagaaggaaatgtaatttgaagcaaaaattaatcttacttaaattgcctgcagttttacccaaaagatactctgacttagtagaaatccttaaaatgtaagtctcttttctttttttttttttgttttgttttgttttgcaatctgaaaaatagcttttattttgcactaataaaaccatcaaaaaatatcttttggaaacgacaactctgctttgaattgacaacatagaccaggggctggtcaaccacagcttctctatcacatccatcctgctgcttgttttcctaaatagttgaaacacgctcatgtcatttatttacatattgtccaagtctgctttcacatctttttttttccttttttaaattttattattactatactttaagttttagggtacatgtgcacaatgtgcaggttagttacatatgtatacatgtgccatgctagtgtgctgcacccatcaactcgtcatttagcattaggtatatctcctaaggccatccctccccactccccccaccccacaacagtccccagagtgtgatgttccccttcctgtgtccatgtgttctcattgttcaattcccacctatgagtgagaacatgtggtgtttggttttttgtccttgtgatagtttactgagaatgatgatttccaatttcatccatgttcctacaaaggacatgaactcatcatttcttatggctgcgtagtattccatagtgtatatgtgccacattttcttaatccagtatatcattgttggacatttgggttggttcccagtctttgctattgtgaatagtgccacaataaacatacgtgtgcatgtgtctttatagcagcatgatttatagtcctttgggtatatactcagtaatgggatggctgggtcaaatggtatttctagttctagatccctgaggaatcgccacactgacttccacaatggttgaactagtttacagtcccaccaacagtgtaaaagtgttcctatttctccacatactctccagcacctgttgtttcctgactttttaaatgattgccattctaactggtgtgagatggtatctcattgtggttttgatttgcatttctctgatggccagtgatggtgagcattttttcatgtgttttttggctgcataaatgtcttcttttgagaggtgtctgttcatgtccttcgcccactttttgatgggtttgtttgcttttttcttgtaaatttctttgagttcattgtagatcctggatattagccctttgtcagatgaataggttgcgaaaattttctcccattttgtaggttgcctgttcactctgatagtagtttcttttgctgtgcagaagctctttagtttaattagatcccatttgtcaattttggcttttgttgccattgcttttggggttttggacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctatacatggctagccagttttcccagcaccatttattaaatagggaatcctttcgccatttcttgtttttctcaggtttgtcaaagatcagatagttgtagatacgtggcgttatttctgagggctctgttctgttccattgatctatatctctgttttgctaccagtactatgctgttttggttactgtagccttgtagtatagtttgaagtcaggtagcgtgatgcctcccgctttgttcttttggcttaggattgacttggcgatgagggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatgaaatgttcttccatttgtatcctcttttatttcattgagcagtggtttgtagttctccttgaagaggtccttcatgtcccttgtaagttggattcctaggtattttattctctttgaagcaattgtgaatgggcgttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacagtcatgtcatctgcaaacagggacaatttgacttcctcttttcctaattgaataccctttatttccttctcctgtccaattgccctggccagaacttccaacactatgttgaataggagtggtgagagagggcatctctgtcttgtggtagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaaggccttttctgcctctattgagataatcgtggtttttgtctttggttctgtttatatgctggattacatttattgatttgcgtacattgaaccagccttacatcccagggatgaagcccagttgatcatcttttcattagcaaattgagaaaaaaattatttaagacaatgaacacttagtatcctaattttaataaaggtaagatttttcctaacttaaaaagcaaacatacaaagtattatagtttctttgtaagatattagacttgtaaaagaaaattatctttgtctgcaatgaatatacaaagaaaaactgggtaacattttattttgcctttaatttagacatggtttaatatcgacatcaaataagtatgataaaatgaatataaatataattattttatatactaattaatatattccgtctgtacaaatccaattgcttctttaaattctattttaaataagaacaaaatagggagtaataaataaataaaaagcaaattaaatgtttaaaattatgattaccccaaactaagttcaagtaaacattattgctccattctgcaaatgagaaataggaggatgagagagaaagtaattgatttgccccagtctacagaattagtcacctacatacagtagaatttaagtccactgctacactgctctgcctcagtgctcactataatatttagtttaggtcttcttagggactgcatgtttatgtgcctgaaattcatgtgttggggccctaacacccaatacaatagcattaggtggtgagtgccttgagaagtaattaggtcaaggtgatagagccctcataatgggattagtgtccttataagaaaagaaggagagctaaccctttctagccccttctctttccaccaggtgagaatacagtgagaagttggcagtcggcaaaccaaaagaggcccctcaccagaacctcaccatgttggtaccctgatcttagacttccaccctccacaactgcaaaaaataaatgtgtgttatttataagccacccactgtgtggtaatttgttagagcggcccagattgactaagacatgtcggctaactcagtgaatcaaaaaatttactataaaatagcagattctaattcccagtttttgtcaaccatgtttcccactgttgaggtcatttgagtttctcctttgagtttctatactagtgcttaccttacataggaaggataagggagactcctttatccttcctaaactaaactccctgggagacaacagtgagtggccactgtttacttcacactggttccagtttcagccactggccttcggccttcatgcacttttcatcctgataacctgtctagtgcctcttaggacctgcactctctacctttctcttatctgtcccaatcccactacttcctctattcaaaactagtttcctgtcccttctgtgcctactgacccagccaaagagtgttctgaggataactacttgttctgaaccttgggtttggagaaatccttttttctagagatatcacttattttggtttttccattgctcctatcttgcagatacacagtgcaactactaagctagatttccttctcctggggcctagagctggggatttcatgtcaacctctcctgtactgccaatccacttgagctctctttctcagatacttatcctcatattgtaatccttgctttaggttctggtctgttctgagccaagctaccatgctcagccacagaagctgatagcatgttatcagcttaattacccctgccacacagaggtatgctccatcttatttcctccaatttgcaaagaaggaaagggaagccaattaaaatgtctatgaactaacttgggtttcagtcgtctatcagaaatctttcctttccttccttctctgcccatcattctcattctctctctcttttctccctctttctctctctctctctctctgtctctctcacacacactgacattcacatcctttcctacacagactgagatagatactattcttttgagcccagaaacttccttcacattttaaatgtctcttctcatctatctctctgaatagaatgcgaggggactgaaggcagaaagaacatgttatattaatttttttatatcttcatttgcatggcgtatagtacagagtcaataaatgtttagtggtttaaatttctgaaggtgacatggccagtaatggtggagataggatctaaacagaagcttataccatgttatcatcagcttaatcacccctgccacacagaggtatgctccatcttatttcctccaatttgcaaagaaggaaagggaagccaattaaaaagtctatgaactaacttgggtttcagttgtctatcagaaatctttcctttccttccttctctgcccatcattctcattctctctctcttttctctctctttctctctctctctctgtctctctcccatcattctcattctctctctcttttctctctctttctctctctctctgtctctctctcacacactgacattcacatcctttcctacacagactgagatagatactcttcttttgagcccagaaacttccttcacattttaaacgtctcttttctcatctatccctctgaatagaatgcgaggggactgaaggcagacagaacatgttgtattaatttttttatattttcatttgcatggcatatagtacagagtcaataaatgtttagtggtttaaatttctgaaggtgacatggtcagtaatgatggagatgggatctaaaccaaactgtgtctgattctaaatttagggttttttttttttttaaacccaaaaatactctatagtcctaggggaaaaataaatattaaattaaaaataaaatcaataagtttgctttagttccatttatttatttaccaatagaaggagggttactctggtgtcttaatcttgtaagtaaatttagggtaagcaatgaaaatctttattctcagagtattctcaaacttattagactaaaagatgaactttttaagcaatctgatataataatatattctggaagaatacttttccttcaaatatctgtctgacctaacttccctaaatcctactattactgatgtgtacttataaattaaggttctctgttctgagattcatctattaatattcttgtgaataatatcactaatagcttatatttcatatatttagtgttttagagttatatagcaagtatttcaccctagggctgactagtagcctgtatgcaccattactatagaccaaatagttttcattgttgagttttactggttgataacatattttgattaatatcgcttctgacaaagaatttttcattttgatttttggttatttgaaaaagcttaagaggagggaaaagcagacctcattataccagttttatcaatatggaattcagatctcaaggagatgaagtaaccttccaaagcagcatattaactatgctgcttaataaatcttaaaaatatataagcaaaaatctccaaaaagagaaaacagaaagatatccccaaaaattgtccctttccaaattttgccttaacccccacactatcttcaaaatctatgaactctgacaagataattcttccaaaatgtctttgcttgtgattttgagtctcaatcataagaaaaatatagaccatgtcattaaaattgaaagtatatgttctaaaggcaaatctaattggcaaaataattaaagatcacaggcatgattaggaaagtaaagacaagtagaatttagtgaagttgcccttagctttatggaattcaaaagtttaatagagacaaatgtggcaagaaatatcctactcttatgatgaattaaaacacagtaaagactggcatctacttttgagctttaaaataaaaagcaggtattttcctccttcattccagtggcattaatgctttttaaagttctcaagatcctttttcattcagcataaagaagaaaaagaagttcactgttatctattaacatattgtttttatctggttcaatgcatccaagaacacctttcctaaacatgtctttgttttactacacactaactaaaaataaagcagaatacactgtctccctccctcatgccaccactttattctttcaatatttatgagctaattagtccctaattaggtaaataataaataatgacggcaaatcagagcccaggtaaagcccaattttcatgatttcattaaacaattaagaagtagaaactagcatgagttcttggtggaggtttattctaatagtgattctgtctgatgtattttatctgaaaagcaggctcctgctcacctaaaatatgtcaaagtaataaggaaatattgtgtaatctgcagggaaggcgttagaaattaatgatgactctggaaaaatctagaaatcaggagtgtgtagaaaccaagtcattttgatcaaatccaaatggtgtctttggcggaataccaaattaaaatagacaaaatgaaaagtacccacttgaatttaaaaacagatgaacataaatattttctcaaaagttaaggtcttaaggaaatctagtattccccacagctgtcaatcacttttgatgtttcattatgaagatttactttttgcaattttacagcaccatcaattgcaaataatcaattataaatctctttgttttcaaaactgggtttatctttaatattttctacaaatttgccaaattatcccaaaccaaaggtgataaattatagatgtgacagttttacagtattgtgtggttattttagattcctcataataaagatatgtaacatgcttctggattttcctgtttttcacatatttaatttcttcttatctgtatttctatgtctaatctgttaaacataatagagacgaattaagacaaaattctgcaaacaaagcaagactgacctagaagtcagagtatttgggttgagttttgactccagtgattacggaatctgtaaccaggtaaggcttttgcttctcagctctttttttcagagcagtgaggcaaatcaggtgccactcctaaatcatgggcttaactcatgtttgaaaacactttataaatcatacagcactgaacacactaaaacaaaaataaacagaagcctgccttaagtgacattgtacaacagcaacacaacattagctttcagtaaacctgagcaaatttaaattttttaatatgtcactttgtggcttggggaaatgattgtgtttttatatatatatatatacatatatagtttttttttttaaaataaagggtgcttttttgagtggcaaaactattggctattacacaattagtaaggactatacattaggcactttatgatgtttcatagttacagaatcctaatatgaattctaagaacaaatattttggggtaaaattttagccaatgaacctcttaggttcttggcttccaagataattatgatctaaagaatactcttcatgctcatactaaggacctttcaaaataacaaagtttaactttaattaatttccattttccaaaaagtgaataaactaagcacttcctgtgtgctaacaaatttaaattttgcactgactctgtgtggtaggttctattattaacataaccatttgacaggtaacataaatgatagaatggacaaatttccatatctttcccaaggtcacacagctaataacaagtcaacaacaggagttacccagacatcctggatatagctgggaaaagaagcaaggatagacaaaaagactaatggtggtggtggtagacaggtttttctaaaaatggaattttggatataaatgccaagaaatatggggtgtagtttctggatgtaaaattaaagaaatgctaacacacatacacacacacacacacacacacacacaatcatcacatgaaaaaaacagcaataatggtcatgcttacaattgtatcattacttctactccaaattcagttgtttcacatgaataatctatggcaacagtgaaactgaataatccctgataaatttttcttcttattgactcttccctttgaactggcactgttattgctacttcttaaatgtttctctaatttgttctgttcttttctcatatctccttctaccattccttaattgcttaattaattgcttttgtttggggccttgaaatagccttcccactgaaataggggactctgctcacttcagactcctctgttgctattgccattattgagtctttgtaatgccttcaaggttatctttgtccataaatctgatcctggtactctactagtcccgtgtttttaaagaacaccctctgttgtcctcagaatacaattcagtagccattgtgttgtgtaagtatcccctacttcccttcccctttaatttatcttgccctttcttcatcatatggaccctctgtcagccacacttgccagtacctcaagcatacaattctctgtcattctgatttttttgcctgctagaataatttttgtcttgtagtttactttgtaggctctgacactttttttttcaaatatgttccaacatgacatctctgaggcttggcacggtggctcacacctgtaatccaagcactttgggaggccaaggtgggcggattgcctgagcacaggaactcgaggctagcctgagcaacacagtgaaaccctgtctctactaaaatgcaaaagaacagccaggcgaggcagtgtgcacttgtggtcccagctacgcaggaggctgaggcaggagaattgcttgaacccgggaggcagaggttgcagagagccgagatcgcaccactgcactccagcctgggcgacagagcaagactccgtctcaaaataaaaataaaccaaccaaacaaaagacatttctgagatgcttttcctcatcataattaatctttctctcccctatgtttccataacactttgttcatatgatttttagcacttgcctcatattaatgatttgttaaatacaatttacttgactagactgtaggctcttcaaaggcgaggaccacaaatcttattattcttaacaaaacagaggctaaaacaattgtggtcatgctctatagcatagaaatgtgaagctacaatactttattgcttttatgtttgagcagacaaaaatgtttcaagataatattgatcattctagcagccttctatgtgggcatttttgttagtttactataactttagaaaagaatgtgatttccaacctttaagctattaaaaatttgttattgtaaaatatagccaattataacataagaatcatttacagtcaattttttaactaaattgagagaaattataattatggagcatggctttaattaagtgtgttcattctatctatcatctcttcttggaatgaggcaaaatctacccttaaattaaaacaaataatcagagttttatatatgtttatttatatcacaacatatggtactaaggcacttctaaactgagtattaagagattatcctacagtacttgttgtccttgagccaaagacagtggtcagaatctctgtattattttcatttgaaccagtgtacagtattctgagttttttatagaaaggatatttttattatgcaccatttaatttatttaggcagtgcttaacccgcacttttccttgcaaatggaactttgtgaagaaaaatttgtgtaattcattgagatacaaaacattccaaggaataggttctcttttctcttgtaaactgcccttattcaaagtggctgtgagacaaaggaggtggcatgaactggctctagagaacatgtcactgacagagacaaatgagtcttaatgagttcaggggaattctgacagctaagatttcgagctctgaggaaagaactactgcatggaggacacaattctgaatcatgccaggttcagagtaagctttgcagaaatcagcacaattgatgtgtatggtgtgtttgtttttctgaaaagctttttacttttgtagaaaacattgcacatttgtaaaatgaggaccaattagaaaagtaaaaattcttacttgttcactataactcaaaaatataatcaatccacaaaaaaaaactcataaaagcaaaatcatctaactaaaatcttagactccaagtcagttcctttctctctcctctgagtttaggcttattccagggagctgcctaataaggccggttcatggcacctgctttgtgtcaccgccactttgaataaatgtcatttccagtttctgtaactatagtgatatgatgatgcccagctcttcctttgtcaaggattctgatgactgtctcatatgtactgactagcctttccaaggtaggtgatacccctttagttaatatatgcattaatttactccaacattctgtaagaaatagaaagtgtttttattatgccaaaatcctatgtgcccactgaatggcccatagctataccatatggagggcacagcaagaattggagaaaggctctcccttcaggctaaaaaatataggaaaaaaagtgttcccataaagagcagaggctgagctggagttcagttttttctcacctctcaggaaagggctttttatgtgttttgtaaactacacaattcctagtggtgacattgtcccaagaagacaaagagacctgacaatagggtcattagtggagtgcagcagggcacagttctgtgggctcgaagccatctgctaagtgggcagtggaggggagaagagagaacaaggattggcataatgttggcacccagctttaagatgtattatctaaaagtttttgagatttataagaaaatcctgttctactgagcatagatttctcatttcagccacctattgattactacctaatatccatattgtgcactgcaagatgttgagccgggtatggtggctcatgcctgtaatcccagaactttgggaggtcaaggtgggtggatcacctgaggtcaggagtttgagaccagcctagccaacacagtgaaacacccgtctctacaaaaaatacaaaaagtagccgggcatggtggcaggcgcctatagtcccagctactcggaggctgaggcacgagaatcacttgaatcacggaggcagaggttgcaatgagccaagatcccgccattgcattccatgcattccagcctgggcaacagagtgagactgcatctcaaaaaaaaaaaaaaaaaaaaaaaaaaaaaaaaaaaaaaaaattaatacaggggtttgacagaggtttgctgtgagaccatttctgcctgaaaatttagagcaatcctaaagggctcctgaagtgtataatgtcataactattaataatatgtacaatatgtcaaagaccaattgttaagcaatggcctgataaaagtttatggaggaagataacggagacagacttatgaatgtagcttaacagcctatacgagattctaagccaaaaaaaaaataaacattaggctcatcttgtatcaatttgttaagcgaaactggttggcataagtgattttgataatagaagagctaacctgctaaccttatattttgaattcatttgctaaatagccaaggtgaattaattacaagcatatagtttcttttcagagcagagggagaaaaaaggtattaatccaaatggaacatttcttccaacctataaaattaaaaatgtgaaaaaccaatttaagaataacaacatactttaacaggcacatacattaatcacatgcccgacttgaaagctattgaaacagtaagacttggcaattctatccacccaaaataaaacatcagcattcttctcagagttacaatttatatgctgtgaaattaaatcacgcactataaaaccaaaaacaatagcaatatgcctttattttaaaaaatgcaaatcataggatctttaaataaagtaaaaaaataaatcagtgctatttagaccctcttacattgaaatataaaactagggactatcttataacacaaacataagaaatatgtttggccctaatttatataatggaagagaacgtcttaatatattatttgatgatatcttctcaaatgagaaatataatagagaagcaggctgggcatggtggctcacacctgtaatcccagcactttgggaggccaaggtgggcggatcacttgaagtcaggagttcgagaccagcatagccaacatggtgaaaccccgtctttacaaaaaatacaaaaattagctgggtgtggtggtgggtacctgtaatcccagctacttgggtggctgaggcaggagaatcgcttgaacctgggaggtggaggttgcagtgagttgagattgtgccactgccctccagcctagggaacagagccagacaccatttcaaaaaaaacacagaatgaaaggaacaaaaaagaagacaggaatataataaatataatagagaagcaaatataactcaataagtctcagtgttcattgttctgcatcaaataaatatttttaataccaaggaattttccatcatcttttcagtgataaagttaaacaatatagtctgcaatatgaaaatatacatacagattatatgcattatatacactgattatttttaatcctttctggtaatccgattccttcagactcttaagtcttcaatgtcttgtaacaagggtctcttaatgaaaaaatctctcagtttttgtctaactaaaaatttcttattcacttttaccagttaaggataatttctatggatacagaattctggttgacagtgttttggttgttgttttttagttttgctccccatccctttaactttaaagatattattatattgtttcttgtgaaaactccactttcatttgtattctcctctcactctatgtaatttcatcattttctccttcattttagatttcagcagtttgactatgatgtgtctatatatggtttggttttcttcctttgcatttattatttttggtgtttactgtatttttggatctgtaaattgatgtcttctgggaagttttcatctaattttcctttaaaacattttttctgccccaattcctctctcatcttattctagaattccaattacattatgttagaccacttgcattgtttgtgagtccatgctcattattcttccatttttttcttctctttcacatgagaaaagttccatcttcaactcaactgactttatttcctgtcaccgccaatcttcttttaaacccacacagtgttttccttttttcatttcagttactgcatttttcagcattagaattttcatttcattcttttcatggcttatatttctttgttgagattaaattctgtgtgtattcattatattcctttttcccattaagtccttgaaaatgtcacttctctaacattcttgtgtgctaatagaaacattttaattatgtcattgtcacattctatccaactgcttgttttcttgagtataggttaattttcctgtttcttcatgtagctactaatttttaattgaataataaatagtaataataaattgaaagaaaatctggattttgttataattctctgaaaatacattttatttcaagaggtggtcaatttcgctaaactagaactccaagctcagcatcccataaggttggcagcaggtaaagtcgccaatcagttattacagttgctaacagctgctttcccctgtttccctgcaattgcatgcacaatttctcaaccagcatgcataatttctaggtcagatgaagttttagggagattttgtactaaaatttgggtgttccatcccttctgaggatccctccttctcaaaggatttgcctttaaatttgtggctctttttccagttctaaggtatgccctctgacagcccaggctggtaatgctgcagctttctgttctcaagactgtaatagggtactgccttaggcataaaaaacaacatcacaaggtgcagtttctgtcttttccagtaaatcttatctctgactaacctcaactgccctcaatttttaaaaaaaatatttctttcagtttatatgatagttatctgctaaagttttaccaagtaaaatcttcattattaaatattttacattgctatttaagctattttctggaaaatcctggtacacagctgattatgcatttttttttgtttttttttaacaatacctctgtttgaaaacatttgccaaacatgttagatattgattctcctgcaaaaaggttggtgttttactgttgtttgtttcactaatttaaagcaactctaagtctttttttttttttttttttttttttttttttttgagacagagtttcgctcttttgcccaggctggagtgaagtggcgagatctcagctcactgcaaactctgcccccgggttcaagcaattcttctgcctcaacctcccgagtagctggagttacaggcacccgccaccatgcctggctaatttttgtatctaggtcttttattcactctgttaccttcctatcttcttctcttcttacttgagtatttgatctggtccttccctttttcccaatcactctttgtgctgttagccatttgactacaactatgtaaagaacctacagagaatcacctaggaaactgagaatgtcaattttaaaagatagtactgactttgtagtagactccaaggtcaatggatctttgacagaaagtaccgtcctttggctgtgatatgaaaggagaattagtattattgatttaacagtcctagtagagattatactctccttctgtgcaataacagttaaaaaaaaaaaaacaaatctgcatagttaatctgtgttaagaaaggggtgcaaaatcattattaatgccactaactgatttctaaagtattcctaattctaggtgagctttcaaaatccaaatgaaactaagaagtgatcttctaattccaattcctatcatatacaatttagaaatattaaattcatacttttagtagtaaattaagcaatgggtttaaggttggaaatagagatcctctaattgctgtgatgcaaagatctcaacttttaagtattacatttaaaataaaattaaaatatcctctctatccaatcatcataataataagaagcatgtattgtataacagctaaatagaaagtaatatctaagatggtctctacgtacattactatttattctacaattccttgaggtaaatacttgtcataattttgcttattaggaaatgcaatttcgtgaatctaaatcatttgcccaaggttacatagtaagtaagtgatggaactaggatatgatataactatatatcccatgctctttctaaatgcctgataaaaaggcttggtctgagtttatttacttcatttgcaatagtcaatgaatgtttttaaaagagctgtaagattaaaaatacccaaattgtataaagaggtcagatgatacatccaaattataaaatcaatgtacattatcgaattgacataccaatagaaaacacacacacacaaatttaaaaaaaagatttcttgtagcaagtgaagagccaaagaaaaatcatgtttattaaattgcactcaaaaacaattttaaagtattccctggtcctggagtgatttgctccaattgctagtttccaggtttcaggtactgtgaaataagattcctaagtcacatgttaattttgtaccagtgggctctctttcctttctcaatgaaacaatcgatatttttccccatccttgtcttcctaaagaaccagatttggaaagaaaaatcaactgcttaagatttaaagcgtaggttcaatactttctatttgtaacttagcagcagtcacacaaatctcaaattctactaaattgattctaagcatgaatatctgcatctgtcaaatgcggatgataatatctacttcttagacttattttatgtattaaatcatacagcttctgccacacagtatattttcataaagcttagttgctttcttttctccttccttatttccatatggtctattgttatttacaaaactttttattttaaaactttaaaatgagattatatataatagaaaatattattaaagtagaaataaaatattattaaatattttaaataaggccgggtgtggtggctcacgcctgtaatcccagcactttgggaggccgaggtgggcggatcacgaggtcaggagattgagaccatcttggctaacacggtgaaaccccgtctctactacaaaaaacacaaaaaattagcctggcgtggtggcgggcacctgtaatcccagccactcgggaggctgaggtaggagaatggcgtgaacccgggagacggagcttgcagtgagctgagatcgtgccactgcactccagcctgggtgacagagcgagactctgtctcaaaagaaaagaaagaaaacaatattttaaaaaatattattttaaatattttaataaaatatttaatattattattttaaatatataaaaataaatgtacaattccactatttgagttgaatataatcattttcatacacacatatgcacacatatacatacatacatatttttgcataattctaggcaaactaaatgtataatttttttacttgcataaacagcataaggaaatcccattgttttaaattgtgagatatatatatatatatatatatatatatatatatatatataaaatgtttatcattgtcaggataggccttagtttacttaatcaatctccaattttagggtatttttgttattttcaattttacataatgataataaatgctgtaaaaaacatctttgcaaatagtgctatttatctcttttgttgttcattcagatagaatttaaatattgaattaaagcagtatacaaattttaatgctcgagtttcaactgcttactgactttttcagagacttatgccaacaaatataactacaaaaaatgtatgagtgattttttccatgtaagtactccagctttgacagctcttatctcataatcttctgcaaaaatgaataaaaaaatactgtcttactattttactgatttttttttttttttgagagagagagagtctcactctgtcatccagactggagtgcagtggcatgatcatggttcattgcagcctcaacctccccaggctcaggtgattctcccagctcagcctcccaagtagttgggaccacaggcacacaacaccatgcctggctaatttttacatttttctgtagagacagggttttgccgtgttgcccaggctggtcttgaacttctgtactcaagggatctacctgccttggccacctaaggtgctggcattataggcaggagccaccatgcctagcagattttttacaattgaatttctataatttaccctgtgtttgttatttccatgtatttcataatatgtaaatagcacatttcctttattgtttgcatttttctaatggcattttatttacttttttctaattgagctgttcaaactctacatatcataattttaacaatctgataataatagccaatgtgttctccttgatgaaaataagtcactgtgtatttacctttaaattctagtaggcattttcaatcgcatgttcttaaaatttacaaagaaaaaaagtatgtctataacatgaggtgagagtatgtattctatttgtctttcttctatataatggaatacaactgaaatccaaagggaccgacttatcctgatgaaacacacaaaacttatttagtgctcaccacaaacttattttagccatgcagaaaaaagaaaaaaaatattaatctaagaggagaagacctaaactattgccctattacaaactgaaaaagaatttgtgggctgtactccacgtacaatggtacaaaatgtttatagaaattaatgtatagaaactaatgatggcagtgtcacgttgtatttataattttcccttaagtgctttcctaattctgaaaaaaaatgcagcaaattattgatgatcaagttgtacattatcaccagatctccagagctctgttctctagttatcctgaacatgacttgccatgcgctgcatagtgttaccctgccttcttgtacactcctagaacacctagccccgtccctgtttaaacctacctggcctcaaatctgtttaattatcccttccttaaagatgccttctatgatccttttgtacttggttaagttaaattgctgtgttctttcattgaatcttgaacttgtaaccattgcacttatcacactttatcatttattttttgtctgtcattcccagtaggaagagaattaagcaatggtttaaaacatgtaaaatactgaacagaattacaaaatctgtaacacataatgtgcatttaactttgagatcttcaaatattttcttttacaaaacttaaaaaacagaacactgtggcttactgatgtatcttttcttcttctttgggaaggggataaatagtaattaaatcctaaagataatgggtaaaagaaaaagtatagagaattcatgaaatgcaaattcaaatacagaataaaaacaaataaccacaagttaattagcttaaacataatgaataactttaaatctttcccttgatcagctgtgactttgaaacaagaaataagctactgagttgccacattataacgtaaacatatttgtggacagaaaaatataaaacactgagcaatatatgtttaaacctacattaaccataacatagattaattaattaattaatatatttttctataattccactcaagtgaaagagccagataactggaattaaaatacgaattaaatgtttagtcaaataatgttgaaaaaataacatgtcattaaattcaggttaaattcagtcaaattctttcacacatttttccttcctaaccagtcatataaaggctgaaactacacacaagcaatgtcaaaataaccaattactgtgcaataaaatatagttttattctatagtattcataatgctccaaactcatttttgcaatttcccaataagttgattaatgctttttctttgtattttggacaagggtaaatatttctgatcacatcctggtatttgactctgctgtatgtcagaattttttttctggtgcatattttttcttcttacatatctgttaacatagttttagcactatttttagccaaggaaaagaaaagttaaaaaaaaaaagattttcagattagcagttctctgggaacattgctgtgctttctaaggtgttactttgatgaatactacagtggtgacagcgagcagaccagcaaaagtgttgctgaaggacaaatgccctctaataaacatagctaagaactactacacacaacaggcgtgaaattcacccacgaggactgacttgtcctgtgtactttccagtgacaggatttctactgtttaggttaggtttgtgtttccaacagagcttagctgaaatcacagattttgataaaattgggagaagctattacactgaaatatttaacatcacttaaaagaaaatgctatagtcagtgtatgttcaagcaattggagacttgttccatatgggacagattgaagctgtttttagaatatgtttcattgaatataaacacacaatagaaagatacagaggtatgcaaccttatgcctttgtgttataattctaaagtatgacaacatttttaaccaaagccagctatgattacattttgaatagaagatggtccccaaagttgccaactgacatcttactctccctctctgagaagtaatatgcatttaattttatgttctttttatacccataaggcatggacaaacattttaagtttatatgtgtattcataatgattgttgcttcaatgaatttggtaaattaacaagaaagcatttcaaaatgaaaatgacaatcaaaactaatatgtaccaagaaccaaagatttactttcagaattaggaaaattaattacgatctatctataacatagaaggagataaaaaaaataaaaaaataaaacctccccagaaaatattgggaaaaagccattggaattttgttttcttccaaactatgatatactatgacttgctttagaaatgacatctcatctgtcattccaattctgttacaagattttatcttcttgctaggatatacaccattgaaaatataatcttataccttgaaacccataaacatttaaaaataactatataaagaaattaatgagtaaacaaataaatgaataaatttgctgtttttgcttacttccaatccagctctaaataatcctccagatgtatggcaatcaattaaaatttcctaatcctggtaagctgaatatcaaggaagtacagcttccatacaatgtgtattaaatcactgaggtaatagaaatgctggcaccatttttaaaagcctatgtaaaaatctaaacacaggaacatgtaaaagtccttctatgctcatactgcttatttcctttccagccagggcttaagttattttctgtgacatagttagagatactgcatattatgcaaatactcttgcctaaataattcttagatattatttttatttcacgaatatgatcaatatataaagcagatagagaagagtcatggtgggaaggtgagttgtaaagagattaagagaagatgggtacaaaaaaaggggcagattaaatatgtatggctacattttctgacttataatttcaacttccattattccatgattttgaaattgtttaaaacaaagggcatcaaatacttatctgcttccaagagtctggagtaccttagcattctgaggaataaaatgtattggtactatccatgtaccatagaaagaatgcctttttagaatatacttattttgctaaataaaaaataatgtatgtacagattattaaatataaagtagtacaaagttcagaatgaattagttttcattatccttaagaaataaaaacctagtaaatcacagagaaatttctagaatcttgttaaatcaataggttagttttctatgtaaagatgagtttctagaattttaggttttctacttgttcgtatttagaaaatcaccagttacctcctatttgacaaagcaaatggcatcttctgaatttttttttaattatactttaagttctagggtacatgtgcacaatgtgcaggtttgtcacatatgtatacatgtgccatgttggtgtgctgcacccgttaaattgtcatttacatttacattaggtatacctcctaatgctgtccctcccccctccccccatcccacaacaggccccagtgtgtgatattccccacctagtgtccaagtgttctcactgttcaattcccacctatgagtgagaacatgtggtgtttggttttctgtccttgcgatagtttgctcagaatgatggtttccagctcatccatgtccctacaaaggacatgaactcatcctttttcatgactgcatagtattccatggtatgtatgtgtcacattttcttaatccagtctatcactgatggacatttggactggttccaagtctttgctattgtgaatagtgccgcaataaacatatgtgtgcatgtgtctttatagtagcatgatttataatcctttgggtatataccagtaatgggatggctgggtcaaatggtatttctagttctagatccctgaggaatcgccacactgacttccacaatggttgaactagtttacagtcccaccaacagtgtaaaagtgttcctatttctccacatactctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttttgagaagtgtctgttcatatcctttgcccactttttgatggggttgtttgatttttttcttataaatttgtttaagttctttgtagattctggatattagctctttgtcagatgggtagattgtaaaaattttctcccattaggcaggttgcctgttcattctgatgttagtttcttttgctgtgcagaagctctttagtttaattagatcccatttgtcaattttggcttttgttgccattgcttttggggttttagtcatgaagtccttgcccatgcctatgtcctgaatggtattgcctaggttttcttctagggtttttatggttttaggtctaacatgtaaatctttaatccatcttgaattaatttttgtgtaaggtgtaaggaagggatccagtttcagctttctacatatggctagccagttttcccagcaccatttattaaatagggaatcttttccccatttcttgtttttgtcaggtttgtcaaagatcagaggtaccttctgaatttttaactcttcacaatatgtgggacactgttgactatcacctccttcttgagacactcttcccctttcactctgctagtaaaatatcattggacttcctactgtaatatagaccccattttctctgacacctcagatgtgttttagcttcattcagaataaatatgtatatactttaatgctccgtgtaatcttcatttaagcattacatacatactctctgcttcaatgatggtttatttacccaatttaactcattacaatgtaaatgatttgtaaatctgtatctacatttgtaacttcacctgtagcctacaatgttacattataattatttgatagacattttctcctcaagatttccagtatcttcttaaagctcaacaagtctacaaataaatgcataacaattcttcatgtccaaacctattcctcttcttttcttctgttttcttaatgtttcccacattaaatttagactccaattggcctactgatacataataaaaggaattttcctcaatactttctttgcaatttattttatatatcacttttttttcatttctacttcaaatcagcaagttttaaaaatttgccttgatgtttaaatgttgcaaatgctttataatcagcttctatatttacacttaccacagtgtaatatccaaattctggaccatttagaaattctacaatgacacctaaagtgactttccggacacagctcctaaaacttatctgtctttctttgcttcaaagaaattaagactgatgattccctaagtgatttttcatttcccatcttagttctattacttcgtttctttataatttcacttttattaattcaaataaaatttcctccataatattttacatctctgtctctctctcctttcctgtattcttgggggattttgctttattaatttataacgcacctatcctatatggcttcaatgttgtttataatagaatcataatctctcagaccagaagacaccttaaatatcgttattccaactatactatgctatttaaaatgatcttgtaacatggcagttcaattcttcagaaacaagttgttttcacgagtagaatactttacttattagaaaagtattacttatattgaaccaaaatcctctacagattttcaaatgtatgttttcagtccgcatcgtcttagtttccctctcttctatgtctctcagtcttcatttctgacttgaactatttcattaaccttttaaccggtctctatgattctctacattagtacaattttaagaatgcacattaatcatgcaaatgattttactaaaatattcttatgacaaaatctttaataggttctttattgccaactgagtaaaatctaaattgttaatcttttaatagatccttcatgatatgtctccaactatattgacagaatatacacgacacattgactatatgaaagaagtaaagaaaaggaggctaactcatacatttctggattgagcaatgaaagacaaggagctactagaataataaaacacattggaagggataatttgtgaaggtgaatttctgatttttgctctattcaatatgacttagcaatttatattaaagtagtaaagtaagtattgacagaaaatactagcggagagagtatccatttactactagcggagtatgcgtttaatactagcggagagagtctgcaagatcaaattagcagtcaccctactcatttcaggctgagctttaatgtagaatttgctgctcacctatcctcttcatatgagttattccttatctatatttaacagtttacgttctgagcccaagtgcagaacaaatatcaatgtatattaaaatgtatctcatttgatttaacaagtcattattttgtactgcaattttttaggttctgatactgtgtgtcaagccatttttttaatacatcagagatatgtgtcatctgtgaatttgataagcaaatattcaatgtcttcatgtaataaacatataaaatgctataatggataggtcagagaaaagagacattccactagaaattgcctttcagactgatattaatccttttacgcagagattatattgatatgttaatccaatatttactagtaaatacactattaatcacctattcgtatctgtcttgccacaagatgatttttcaaatcactatttgtgttctagatataatacatcatatcttttcctttggttgaccagaataaaacattatcagagatataacaggattattttaatattacatgctcaagtagtaaaatatcataagcctctactaatttcctttattcagatatttaataattgtgttttaataattaactctagaattgcctaggttttattaacaatctactgatacacatttcttatcctgccaattaacttataaacttaaaaaaaacacatactttctgtattactttacttttttttcaccaagactacaatcaatgccctaaatatagagtaagaattcaatgaatatactttatgtaaatgagttttctaagcctagatttaacacaagaaataaatgatgatcatctggattaagagatgatataagagtttcaactttgtgtgaataaagagaaaagtcaatgaacctcttatttatcaacagcccttcatgctaaaaactctcaataaattaggtactcacgggacatatctcgaaataataagagctatctatgacaaacccacagccaatatcatactgaacgggcaaaaaactggaagcattccctttgaaaactggcacaagacagggatgccctctctcaccactcctattcaacatagtgttggaagttctggccagggctatcaggcaagagaaggaaataaagggtattcaactaggaaaagaggaagtcaaattgtccctgtttgcagatgccatgattgtgtacatagaaaaccccattgtctcagctcaaaatctccttaagctgataggtaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaatctactttaaagttcatatggaaccaaaaaagagtctgcattgccatgtcaatcctaagccaaaagaacaaagctggaggcatcacgctacctgacttcaaactatactacaaggctacagtaaccaaaacagcatggtactggtaccaaaacagagatatagaccaatggaacataacagagccctcagaaataatgccacacatctacaaacatctgatctttgacaaacctgacaaaaacaagaaatggggaaaagattccctatttaataaatggtgctgggaaaactggctagccatatgtagaaagctgaaactggatcccttccatacaccttatacaaaaattaatccaagatggattaaagactcaaatgttagacctaaaaccataaaaaccctagaagaaaacctgtgcaataccattcaggacataggcatgggcaagtacttcatgtctaaaacaccaaaagtaatggcaacaaaagccaaaattgacaaatgggatctaattaaactcaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaagcaaacaaccccatcaaaaagtgggcgaaggatacgaacagacacttctcaaaagaagacatttatgcagccaacagacacatgaaaaaatgctcatcatcactggccatcagagaaatgcaaatcgaaaccacagtgagataccatctcacaccagttagaatggcgatcattaaaaagtcaggaaacaacaggtgctggagagtatgtggagaaataggaacacttttacactgttggtgggactgtaaactagttcaaccattgtggaagtcagtgtggcgattcctcagggatctagaactagaaataccatttgacccagccatcccattactggtatatacccaaaggattataaatcatgctactataaagacacatgcacacgtatgtttattgcggcactattcacaatagcaaagacttggaactaacccaaatgtccaacaatgatagactggattaagaaaatgtggcacatatacaccatggaatactatgcagccataaaaaatgatgagttcatgtcctttgtagggacatggatgacctggaaaccatcattctcagcaaactatcgcaaggacaagaaaccaaacaccacatgttctcattcataggtgggaattgaacaatgagaacacgtggacacaggaaggggaacatcacacaccggtgcctattgtggggttggggcacgggggagggatagcattaggagatatacctaatgtaaatgacgagttaatgggtgcagcataccaacatggcacatgtatacatatgtaacaaacctgcacacagtgcacatgtaccctaaaacttaaagtataatttttaaaaaaaggtaatggatgagtttttcattttaatagatgatttctaaagttttcattgtgaaacacatatatttggacttacctaaatgttagcttaaacttgaaaatgtgaccatcatcttcaaaaagcatatttaatccattgtggtagcaacaataaaaattcacaaatctcccatctgcacttgcttagaagagaagtataaaactcatttgtatattaaagttttctttaatgtagtttctaggaaaccattcataaaatcacagctgcagctaatttccatttctatggattttgcatttgttagaaatagagaaaaccgatcatactatttttgaaagccatgcacagaaagccaaattacataatcttaagcatacagatcttaataattcacaaaatgacaactcattatccctattcttaaggaaaactctgatgcatattagcattttataataatccattatatctatctacttcgctggcctaaattttgggaagtcacttcatattcagtgatacgcatgtctgattgtgagaattttctgcccaatttcctggctaggtattacaatgaagaattggtcagtaagcactaatagacagcaaactaatgacgaaaaaagtgaaaaatatattatgctcttatctattgcacatctaatgtcatatcaagcacatgaacaaatgaaaacaaaagcagacttcaataaaatctcccaacctttttttttttagttacatgtagaaatatatccaagagtttaagtttctagacaaaaatgaatgatatcccaagatactaataaaactctcaatgtcaacaaggacatgatatatttgagcaatcatggagaattagaaaatgatagaagattaaagatggataaaagttttctttattttcaaaaaagaaggtaaaatactgcctcacaaagggcattgtttattcagattataatcaatatcataatacgaaatttcattgctaaaggaaactttcatattatattctacttagcagtaatacctgtttccaacaattatctttctggtgttttatctgtacaattttgtgattgtggaggattactccgaacaactctataaaggatttataacaaaaacaatcttgaatataatgaagaaaattttccatcaattaactactgttcaattacgtataaggtataaaaactgtctggctatttttaaaactaatttaacctattatttgtaattagccaaaatggtaatagattaagatgcacaatgccattggttttataaaagaatatatccaagccacaggataaattgaaaatatatacacagtgaccattaattgtccactcttagaaatttttgccacaattttaattacacctcaggattatcttatattctttgagagaaattcatgaaggagatagtggttaacacaagcagattcatcctcaaattttgcatctgagcttgagctaagggaaaagctggtctataaataacatctttggcgaaatctgtcacatatctccagaaactgcaaaggcttcattaaatctgacttctccattaacttcagcagcagtacattccctctttaatgtacttcccatttctcaaactgtgaatttataatgaaatgattgtttacatagtataccttaaaaaacaggcagccatgaactcgcataatatggtagtcaacaaatttaacagtattttatttcaagtagactttaaagttttcctttgcagtgcagcaatataatgcaactgtggaacaaaaaacttatcatgtccacatattattttagtattatttatttagtatttccatctataagtatcatcaagagaaagtcctgaagtctgctccttcattaaacaggacagacttctatggtaaagctatcatcattgcatttgattttggactggaaatgtaacatctgaaagagctttttgcttttaaagagttaacagcttcagtaagcataattggaaaagtctagaaacatggtatatattttactcatccactcaaaaatagcatttagcttacagaagtgaaatctcaggagggtcattacaaatttttgtaagcttatcattaaaattcgtaactaagagttgtgttgaagacaagcaaattttggttcaatataaggataaatggactctacatggcataatgtatatgataaaaggaagacactgggaatacgaaatcttttaacagtagatggagacacaaataggagatcagataaaataagaataacattaatcacaatcaaagtgaagttcagaaaattgcacctcaaaatatgccattttgatatgctgattacttcaaactcagagcacctgggaaaagcacaagcatgaaggggctttccctgaactctgcttatttacctaaagaagtcacatcctctgcctcctctgaaggaaagaaatgtaattgtcctaaatcacctgcccagaaatctcatcaatcaggaaagattaactcctatcacaggaacggtgactggggtggacgtccatccagacagatgttgtcacaggctgtcacatattcttctgaggccccattcatctttctcaaaaatcatttaccgtcccctagattggctacatcctctcttgcttttcccctaagaaaagggtatatgtaagcttctagatctcactgaggctgtgagtaatcattttttggtcatatgatgcccctggacacactataaatgcgtatactgtttttcttgttactctgcctgctgtcagtttaccttatagactcaaatttatcactcagatgataaagtcttccttcccttacaaaataatataaagttgtcccttggtatccatcccccacccatagggtattggttccaacatctcccatagacaccaaaatccacagatgctcatcactgacataaaatggcatagtatttgcatataacctatgcacagttcctcataaaatatgacatagtatttgcatataacctatgtgcatctgcccatataccttaaatcatctccaggtgacttataatacctaataccacctaaatgctatgtaaagagttgttatactacatttttacttgttttttaatcctttcatgctgttttttattgattttttcaaatatttttcattctcagttgttgaaatccagaaatacaggacccatgaatgggagggccaactgtacctggaagtcacatatgccccttactctaagtatggcaaaagtgaaagattctattagtcatattctcccaccatctgttacagatctgtgtttcttacacattaaattattactaaatcccaacatccaagttagctatggaattcctggcctttcctcactacagcactggctcatttcagattttaaccttttctccttcactgatagttcattgcagagtccagataggccaaaatgaagttctaaattttgaatgagtcaataagcagttattgtttattatcactgacagataggcccattgaaataatgattaggtatcttcataaaattgtgactacccatgcattaagtactcataatgggtaattagaagtcacagacattctcaggttaggaggaaggttgaattagaaggctactaagttcccttataatccaaatattctgtttttcatgaccctgataaaatgtaatctatcaagctattattaaataaatgtattaccatcttgcccacagtatttacacttaatgaaaaaataaatgtaatccctcctaaatggaacctaaatccatttaggttcaggcttgatctgagagaaaaggcctcaacctagggttattataattgctctcttcactacagaaacaatgtctgatagatctgaaaacctggttgaaacaactaacaaaagctattccacattacttagctaggccccctacagcctaatccaacctgtggggattcaggataatacttaaggcaagcaggagaaaatcaacaaaaccagtcatatcgggcaaggagttatttaattgcccatgaataatcagtgtatgtgaaattttgctaagggcaatttgaccttaaaatgtggttatctgatctgaaaaactttctaactttcttctgtattaaagaagaaggggtgaaatacatacaggagcatctcaccccttctttgacaattaagctttctctgagattcatggaggctcagaaactatggagctcaggcataaaatgtaaataagagatttccttttaatgaaacacattttactgctgttttgatatggctgctccaaaatccccctagggcaacacacccaaagcaaaatattctaggaaattattgctagagcaatcagacaagaaataaataaggggcatccagattggaaaggaagaagtcaaattattcttatttgtagattatatgattttatatttggagaaacctaaagactccaccaaaaaactagcagaactgataatttcagtatagatgcagaatacaaaatcaacatacaaaaatcagtagcatttctatatgccaacagtgaacaatatgaaaaagaaataaaaaaagtaatcccatttacacttgctacaaataaaatacaatacttaggaacaaatttaaccaaagaagtgaaaaaatctctataatataaactataaaacactaatgaaagaaattgaagaggacaccaaaaaataaaaatatattctatggtcatggattgaaagcatcaatattattaaaatgtccacactacccaaagcaatctacagaatcaatgcaatctttaccaaaataccaatgacattcttcaaagagctagaaaaaaattctaaaatttatatgaaggcacacacatacacagagacactagccaaaactatcctgagcaaaaagaacaaaactggaggagtcatattacctgacttcaaattatactacaaagctatggtaagcaaaaacagcatggtactagcataaaagcagagacatagaaaaatacaacagaataaacatacacacagagacactagccaaaaccatcctgagcaaaaagaacaaaactggaggagtcatattacctgacttcaaattatactacaaagctatggtaagcaaaaaaagcatggtactagcataaaagcagagacatagaaaaatacaacagaataaagaaccccaaaataaatccacatgcctacagtgaactcattttcaacaaaagtgccaagacgatacactaaggaaaagacagtctcttcaataaatggtgctgggaaaattggatatccatatgccaaagaatgaaactagatccctatttctcaccatatacaaaagtcaaatcaaaatggattaaacccttaaatctaagacctcaaactataaaaccactaaaagaaaacattaaggaaactccccaggacattggactgggaaaagattttttgagtaataccccataagcacaagcaaccagagcataaatggacaaatgagatcacatcaagttaaacagcttttgaacagcaaaggaaacaatcaacaaagtaaaaaagacaacccgcaaaatgggagaatctatccttcacctgtttattaatacattaccaaggaactctagatgtcggcataaaaagtgagaacctatgataacatcccatcttttctcctactaaaattaccttgataaggccattgttctctgcctataacttgaagtccttttctaattccttcatgttattagtcatatttcaccatgactatacataaactcctttatacccttgagcttctctttatagcccaaaatctcttgaatgacattgtactactataacattcatccttacattcctagattccttcttccattttctccattcctatttaataatgtttcaagctcagaagatgcaaagatgaatgttttagtctcctcaccccaagaagcacatttgccttaattgcctcttactgctttcaaaggttcattctcaaactctctaatgcactgttcccccaaactgattctttcccttatattctttcccctctatgtttcttctcccatcaattcttattcttattgtttctcatataattctgtgtgaatagcgaacactattctcctagtgcagttccctccctgaattgccaacagaaagatggagttcatcttttggagatcctattgacacctgaaatatcacacgtttaaagcttgactaatctctcaagctttccttctacctacacatgactttggactttcataaaatttcgatttccgttctcttgtcacttcaatatcccctgataataatctgtctcacttctcttttgaaagacttacaaccttcaaatatcacaggaaaattcagtgtcatttttgtttcaaccacaattaatgcagaaatatcaaatcttcccaattcctcccaaagctctctgctgttcacatttggaatttgaaaactttttttttaattgtctttgttcttattttgctttttctttcttattctgttttcttcaatgcaatacacattgatctggaaacctaaaattctcaacggttctcgtcactgagccatgtacatttttagtgggaaacaactgcagcttttacattttcagttgtcaactgcttttgtagtgctgctgacttcttgttctacattactgggcagacaattcagaataaaaagttttatttcatcacatatttcttccaaattgcttgaaatgctttatcattgctcctaagtaaagaatacagaaataccctcattttatggtgcatggctttattgcacttggcagatactgtttttgtttttaaataaattgaggcttttgcaaccctgcatcaaccaagtctactggtcccacttttaaaacagcatgtgctccttcatggctttgtgtcactttttggtaattcttgcaatatttcaaactttttctttgttactatatctgttatagtgatctgtgatcagtgatctttgatgttactaatgtaatttctttgaggtgccatgaactgcactcatataagacagcaaacttaatagttaaatgttgtgtgtgctctgactgctgcaccaactggccattgtttcatttctctccctctgattggacctccccgttccctgagacacaacaatattgaaattaggtcaattaattactccacaatggactctaggtgtccaagtgaaaggcagagtcacatatctctcatgtgaatcaaaagctagaaatgattgagcttagtgaggaaggcatattgaaagcaaaaacagaccaaaagctgggcctcttatgccaaacactgagccaagttgtgaatgcaaaggaaaaatccttgaaggatatcaaaaactctattccagtgaacacagaattaatttaaaaaaaaaaaagagagagagagagagagaaacagtcatatttctgatatggagaaagtttgagtgttctggatagaatcaaactaaccatgatgttccctgagccaaatcctaacccagagtgaggtgctaactctctttaattctgtgaagcctgacagaggtgaggatgctgcagaagaaaagtctgacgttagcagaggttggtttgtgaggtttaaggaaagaggctgtttccataacataaaagtgtaagataaagcagcagatgttgatgtagaaactgcagcaagttatccaaaagatctagctaagataattgatgaaggtggctacactaaaaaatagattttcaatgtaaatgaaagaggcttaaattgaaatattggaaaaatatgccattttgaactttgataggtagagagaaatcaatgtctggctttaaatcttcaaaggacaggcttactctctttttaggagcttatgcaactggtgaacctaaatttaagcaaatgctcattgctcattcctaaaatcaaagggcccttaaaaattatgctcaatctactctgcctgtgctctacaagtggaatttaaaaataggcctggatgacagcacatctgtgtctatagtatttatttatttatttagatacaggatcttgctctgtcacccaggctagagtgtggtggcattatcatagcttataagatcactgcagtcatcccatcttggcctcccaagtagttaggattataggtacataccaccacatccagctatttttttttttttttttttttttttagggatgggatcttgctagattgctcaggctggtctcaaactcctggcctcaaatggtcctcccaccttggtctccaaaactcctgggattacaggtatgagccaccacacccagcctacacccagcctacagcaagcctatggtttgctgcatattttaagcccaccgttgagaccgactgttcagaaaaaaaagattccctaacacggctcactgctcactgacaatacatctagtcgcccaagagctctgatggatatgtacaaggaaattaatgctgttttcatgactgatatcaaggcatccattctgcagcccatgcttcaaagagtattttcaactttcaagtctcattatttaagaaatatatttcctaagtctatagctgccatagatagtgattcctctgctggatctgggcaaaataaattttaaaccttctggaaagaattcaccatccaagatgtcattaagaacatctgtgattcatgggatgtcaaaatatcaacattacacaagtctggaagaagtattccaactttcatggatgactgtgaggggttcaagactttagtggaggaagtaactacacatgtggtagaaatagcaagagaactagaattagaaatggagcctgaagatgtaactgaattgctgcaatatcatgatgcaacttgagagcagagagtcatttcttaagatggaatctactcatagtgaagatgctgtgaacattgttgaaatgagaacatgaagattttgaatatttcataaacttagttgcaaaagcagcagcactggcagtgtttgagaatactgacttcaattttgagagaaattccagtgtgggtaaaatgtatcaaataacattatgtgcttcagagaaatattttatgaaaaaaagtcaatcaatgtgggaaacctcattgttgtcttattttaagaaattgccacagccattccaaccttcggtaaacactgccctgataagccagttgccatcaatattgaggcggaacttagaccagcaaaaagatcaggacttgctaaaagtttaaatgatgcttagcacttttaccaataaagaattttttaattagggtaattacattgtttttagacaatattagcacatagtttatagtatagtgtacacgtaacttttttatataccaaactgatacaaattggttttatagaaaaccaaaactattgggtcacttgctttattgctatatttgctttattgcagtggtctggaaccaaacctgcaatatctccagggtatacgtatataatgtttgtatgcattcttgttatttgataatatgttaattccttagtcatatactgaaattttatgtatttttaaaaatttatatctatatagaaccagaggaaagtgattaagcaaaaagataacttccattttaacatcatttataaaaattaccacaagcctacaatttctaaacggtcatatttcatagctcatcattatgtagataattataaataggcatttcataagtagattaaccattaaatctttgttaaaaatgggacaattttgaaaatttaaaggagaccctaaatattttaaaaatatataatttttgaaatagtgatacattgaccaaaaagttggtttcattgtattaacaaaattaaaaattatcctgtccacattattttcaaaaacacaattatatttaacaaataaaaacaatgtgtttatattcataaaaaactaagtataacaaaaattatttgtatatattcacacacttaaatcaactgctctatgagtctaatgctgtttatctagtaataatctgaagacttaacacagtcatattgcttttagtatttttcatattttctttaaagattcattttctggttcgtaaatacgacactgcttaaaccttccattggcttttctctatagcgtggaagttttttaactgaggaaataaaacctctttacaaatgctaaggtatctgctaaactaatatcaaattctaaacttttcatattcaggatgtgcaattcaaacatttttgcagattctgtctttgtttctacttagagtgcctttctttaacaaattttttttaaagagaaaacatgctgaaatgtcatgccttcttaatttcatcccaatcagatttatatttttaaaaaactttacttaaatataggaaagttattcattcaaatcaagatagtccaaagcttttaagctatggtaatttaatatgtttagttgatacttaattttataggaaatctttatgttttcctctttgcacacttttttaaaaaataatttctattcattgaatcctcctgagtgtaattttttggcatattatttattgaataatttgattaaaatttccaattcatcttaaacaaatgcaatcaatttagagtacttctaataccaaaaaagttcaataccattatggcacacttaagttgacttctaaagtcattcttcaaaggctaaaatattttgtaaatcagacttttagtgggtagcaaaaagagaaaatgtgtattactaagataaaatacctaattttatatttaacattgcatagaaaagaatttgactggcctttgtccctggctcctgagaaaaaagaaaaaaaaaaaacccaggtaagacgagtctctttgttatttatgagccccttgaattacgcttgagtttatgctaaggagatatctcaggatgggggctggtcactgaaatgatcaataatgtgattagaaaattggggctttgagttagcctgacttccagggataggacagggttacagattgagttcaatcacatgtccggtgattaatcatacttacttaacaaaatcctaactctggacatggaaacttccctggatggtgaacacatcaatgtgctgtgagggtgatgcactctaattccatgaggggagggcttggaagctttgtgtttaagactttgcatttggctggtcctggtttttattctttataataaaactgtaatcataagtatagtgctctcttcagctctgtgaatcattcagtgaagtatccaactggagggcggtcatgggaaactaccacatttttagtcagttgaacagaagtacaggtggcctggtgactcccaaatttgtggctggcatttgaagtgataacagttttcttggtggccctgtccttaaacctgtggagtttgacactaactctggaaggttaacaacagaatggtatgtctgtctacacattttgtggtttcataatgctttatgtgtatacctgtcataccttcccaatttaccaaagtgtgttttcctaacatctttctcttgatatccaacagcagaatgatatcagagaaaaaaccctagaaaaatctcttgatttaaaatttaggtaaattctagctgggtgcagtggctcattcctgtaatcctaacactttggaaagctgaaacaggaggatcacttgagcccagcaatttgagaccagcttggccaacacagtgagaccccatgtctacaaaacaaacaaacaaacaaaaaacccttaggtaaattttatacacaaataggcacacacagaaagacacatatacaaacaccaatatgaagctattaatgaatatctgggtaaaaataacaggcacaaaggtaattccttgagatgaatcctgtgatttagaatattaagaatgtgagaattgtcaaagtggaagtgataaaaagactaaaaccagaattgccactttttctttctacacgtcactcagaaaaaaaattgcttaacaaatgtacgcaaaaccctcttgaatagatgatacttcatgtaaattgaatggtttcctaacaccaagactgacactttgttctcagaatggacgaataataaaaggcaacattaatttgaattaagcaaaatacataggatatgtgatggaccatttaaaactagaacttgaagaaaggacatatttagcataaacctgaattggagaattctgtactgaaacatagttttgtttgtagaaacaaattcatataaacaaattgtaaacattttgaagtttttttctgaaacagtcccttaataaacctaaggtaaatttaacatttatcatacctggatttatctttcttttttatagtgaatatatgtagtgaatttaaaatatatagtgaaggccgggtgcggtggctcacgcctgtaatcccagcactttgggaggccgaggtgggtggatcacctgaggtcaggagttcaagaccagcctggccaacatggtgaaaacccgtctccactaaaattacaaaaaaatcagccaggtgtggtggcgggtgcctgtaatcccagctactcgggagggtgaggcaggagaatcacttgaacttggaagcgggggttgcagtgagccaagatcatgccactgcactccagcctggaggacaaaagtgagactccatctcaaaaaaataaataaataaaataaaataaaaaatatatatagtggaatccctataacatttcatttatgaattgaacaatatgttgaaagtgatataagatttacaagtataagacttacaatagaattcctacactgagaggaaacagtgttaagtattctcatatcaggaaattaagataatataaattatttctgaaacaattctaacaacacttcacatcattgataaaatgttgaaaatgttaaatttattcaacctctttttagtgaatttacagcaattatttaatgaatagtcatcatatacaacactttttataaggtgccttacaaacattttgtctaattcacccaataaccctgcattttgatcatttacagctgaaaaatctgagtcccaaaaatatataagtccacttcctatttttgaagagctttcttctccaatttctatctatgtcagtttcattttgatttgatactagttcttccaactatgcccataggttagagcaacattgtagctgtgaacttacaactgaggtgacatatgacacctgagcaaaactagtagcctaattattaccatctacatcctcagacccaatcataaatgtcgtaaaattcttcttgacaaaatgtaatttgttaagtaatgaaaacttaaaacactgagttaatctcacttcattctgctccacaaaggaaatttaaatgattaatcccatcctgatacctcaaaaactttgtctcccactaagtaaaaataatgtgaacaaggaaattaaatgtgggtgaacctttaggaagcttttttttttttttgagacggagtcttgctctgtcacccaggttggagtgcagtggcgccatctcggctcactgcaagctccacctcctgtgttcacgccattctcctgcctcagcctcccgagtagctgggactaccacgcctgactaatttagtagaaacggggtttcactgtgttaaccaggatggtctcgatctcctgacctcgtgatctgcccgcctcggcctcccaaagtaggaagcttttacctacaactcctatcctcctaaaagtgtcatgcccacacagaaaagtcaatgtatgtttccatggctgttttaagggtagactattaaagcaacaattttgctctaactatgtaatcctttatgccagtctcattttataagagcaaatactcctattatcttcatttctataaagaattatattttacagacaatctgatattaacataagctttccataattgtcagtagtaaggaacatgagatgataaaaaggaataatcgcaaataaagaaggagtagctggcagcctgaattacgtctgttattaatctgtctcagaagggaagaaaagaaatgacagcagaaaaaaagcataaagggattcgttgggcacactggagctacacatttgtgtttgttaacaacttccttttttcctctgccctgtaaactcaaaatacctttataaaatagcccaaaataattatcttgtcagaagaatctttgtgtttttgtcaaattaaattaaactgaaattcatcatgggaagaagatatcagagaaaaagcaatgaaaaggtaaattaaaattgaactgtcagatttaagggctggtccaatggaaatgaccaataaactcatgagtaatgataaacagggtagatatttttcctttgatctcactaaatctacaccctattcccaaatgttcttttaagggaatgatattaaattaactatagatttttctatctgcagaaaccagtgggagcaatgaatggaggaagtgtcatcattaagctgccattattcctagtgcatagcaggctcaactcaccctgtagccttgtgtggccttaaaatcctccaacacacactaatagttttccctatagaatatatttgcatgtataatcatgcctgttccaccattaaacaatattttaatggaaaaggctgtgcccttgggtagttataacttgtaagcacaggagtcaactttattgtgatattataaaagagtggtaaaaataattaagcagtcatgcctggcacggtggcttgcacctgtaatcccagcattttgggaggctgaggaaggacaattgcttaagcccaggagtttgagaccagcctgggcaacatagagagacctcacctctacaaaaaaatcaaaaaaatagctgggtgtggtgtcacacgggaggctgaggtgggaggatggtttgttccctggaggttgaagctgcagtgacccatgatcacaccactgcacccagcaagggcaacagaatgagaccctgtctcaaaacaacaacaacaacaataataataataattaagtattctatttgttaatatcattctcatggtttagagattaacttaattgaatatgacacagttttgagagaaaattactttgaagagtatcctcattttggcaacaaaataaaattgaaatgtgttctcagagtaacttgagatggtggtataatgatttgtgtataaacaacaaaatctgaatactgctaattagtcatggttctcttaaattgagtagttctatcacaggtcaatatcattctctctccaacagatgacagaatttattttatcattctaacaatgtaattactgaatttttctcatctctcctaatctgagattctattagcactgcccagtataataccaccttaattatatgcatatttgatttccatttttaaactctataactggttgtctcttttttaggttgaggtaggtctaattaacttaatttaggaaaggtattttatttaaaataatatcactttcttgtcattactctcccacatttgtaatctaaaagtatcaaatactcatttttcattacacaatatttttattactagatagtttactatttcagtatttgagattatagtatttttcatttaggtcacaattatatttccataaattttaagttagaatattaaattttgcatcatttaatgcctcatatcaaagggcagctgcagctttatacatcaaaatccagattatcaagagagtttatatgctgggaaacacacaaagcaatgatcacaaatggaaattgatagtaatttttttcaaagagaaaataaaagaggaaagaaaaataacaataaaatgagaggaaaatggagacagactaaataaaagactcccttgactacaggtcctcatacgtaagtgaaatgatcctgcacaatggttttctggaagattagcccttctgcactctgggacgggttcctccctatgaggaaaatgcccaagcaagaactctcatatggtttcttgtgcaacgaataggagctttataaaagcagaaaactttgaacaaggacaagtcagtattaggtgagccatacacatgaagtaaaagtgtcagtctgttcccctcactattactttctctctgatacaggttataggttaagaaaatacacaggcattccttccagaggaattgagttgctgcaagtttgtccacttcaagttcatgaaatgttttataacttaatattgttgtcaatacataggggaatttcacttaattggttttaaaattatggataatatacaaaagaagtaagacaattaagatgaactaagaatggaattaagatatatcaattgaatggaaatttattcatctgccagcatcacagatttttctttcatttttttttttgtctttctacctccttttcttcttcaaaaattatttgacacctaccgtgtgccagaaattgttcttggctctgctaacacaacaataaacaaagaatgtcccttttccatgtaaaggaatggggtgactggtaggaaacaagcaactttcttacagggtgaaaatgcagtgaggaatatccataaaaaaggaaggagctgcaggagtacagagctgaaagtgaatagcactgagctgcttacagagctaaatgttgacatgcagaactaaatcttaaagattaacacaggttaactaaacccagatggtgaaaaggagagggcattttaggctacacacacacacacacacacacacacacacacacacacacacacacagagttatatacagttcaaaaacatggtggcatgaaaaacatagcttttagattgaatttcaaaaagtgccctttggaaaatattgaccaaaaatagtcctcatctaacacagtgcttgccaactaaatgagggtaaaattaagttctaactctgacccttcacttgaatggccattttaactgtccctggaaagtttttaaaacacacctggattttggattcagcctccttaacatgattcttaaaggatgtgccttttgcttgtaaaatgcataacacctctatcttactttcatatgtgaagtacacacacacacacacacacacacacacacacacatatacacacactgctatctatggtaattaaagttttcactaagaacttgctcaaaattatagtgttagtaaagacataaaacaggtattagcttcacatataacaggtctttccactctactcacgtgcagccaggatttttgttttgtttttgtattggctattttcactattttagtcatcagtaacatttgtaatcatatatttaaaaaataatattaagagtattttctctttcttgagcaaatgttacgatcatcagattaaaaaatccacaaattacccttagctcaaagttttatccttaaaaatatttaataatttgtagactctctaccttaataaggaagactgtctcattaatacaattaatcttctttagatgattcagaaaagctacaagaccttggttaaattttctgatcacatcaatttttaggaatgtaaagtgcaaaatttgaaaaaaaaagcataataaattggaatgaaatagaactggtcccagaataacgctctgtgccttagtttcttcatcatttaatgggcatactaacagtgtttaactcagttattgtgaaaattaaattatttaatatgtgtaaagtagaagatttcccagcacagagtagaatttcattaaatgttaatgactgttattattattagttttaaaaatcaatcattttttattctgttatccattaaattggtaagcaaaaaaaaattaacactcgttatattttaaagtgtgctttaaaatcttagaagtgtcatgacaatggaagaattgtttacttattcaaaccactaggttctttttttaagtagctttattttaaaattatgtacgtaagggctcggaaaacaatacatcaaaatatggtatcttggcaaactaagtattttaaactgaaggaaactgataaaatcacagaagttgaaaggtctctgatctttttccaccctttctctcctgaactaaggctcagaaaccgaaattccccttacccctttctctctgaagcaggtcataaagcctagacaggttactctctgacagtctccttcccactcccctggagatccttttatgactggtgtcctgccctacacccagagggaagaaatgtcacatacagacacaggaaataatctgaacagacagaccttgctaagttacctccagctaatgacctttagatcatatccttttgtcctccaatcatacttctacatgattgtccattaaaatatactattttccctgggtctctggttcttcatttctgtaggtttcaatgtcatatgaaactttatatgctttgtttttctcttattaatcttttcttgtgataaaggaattgtccatgaaccttgttgtagataaggaaaaattattacttttcctcctctaaatgtaatattaaaggttttacccatgtagaaagatttatattttaaaaattcttttgagaaattcagaaataagacagttacatatggctgaaagtttgtttgatatttgaaacctcaagacttctgtgagtttactctttggaactttagggtgtaacatttcaccatgtttagagttctatttaattaattaatttaatttaatctcaattactgttttggttattaatattacaaaagaaataaaaactgctcactatatagttctcaactaatacaagatttatttaatattcccagtctttatctgtttttacaaaattcaaacatccatttttttaacattcaggatataactttatatctaaagtcttaatatagtttaaagtttaaaattagtaagtacaattttaattaatctatatttttacaagtagattatgtgggcatcattattatcatcatcatcatcatcatccttatcctcatcatcatcatcctatgatttggtgccaagaatataacataacttctcatgctagtatattttaacatacaggaaatgacttagatatttaacttgatgggataacctagcttaagcacaaatcttccagacagatttgactaaaagctaccaaatgactgaagtaaaaaatttgtaggtatttgccagattatctaaaattaatgtcatgaaatgttagtgtacactgaagaattcctattgctatttttaattaccaaagctatattttctttttaattatgtcaccgtgaacatcttttatcgatatttaatttaatctgatattctctttcttccttcttctcttcctttgttcctctctcgctttctttttctatttcccctacttctaaggtatttttattgcatctttaaattctcatgtagattcttctgatgactctgcttatgtttcttttattacacatttttctagagtagatatcatctggaacatggaatctactgacacatttcttttttcaccttatcatctccatgtttattaggcaggccaattgattattaacagtcttttggcaataatcttttcaccaccatactaccttaccagctgggagagaaacttcagcaaagcaataattaagacactgataagacaagctattttgttgctttcctggtttacacagaggacgcagaatcgggagctaaatatctttaatactcaatatctaaaacattactcagatcatttgacttttatacctacattgtatccaacctaatttttaaactggatagttgatctagtctaaaaacaaaatctaaaaaagtaaacaaaacacacctaacattgttagtgccttacttttaaaaagattaaaactttcagtaatatggataagtagataaatagagtactaattccttattattaccctcattctagaattagatgtttctgacacaaatatacaaagaaatttcacatgtaaaaacctgctgcggaatttaaaattcttttgtgacaatttgctcctgtgacaagtatatttttctattctatcatgctcatatttcatactattaaaataaatacttatgaggattatggacaatattgctcacttgataatttaatacctgatatgattgtactgttgaaaaaattgtacaagggacaattcatgctgtttcccatttttgacttcttccatgtctacattggtttaattaaatatgcttagtttctaaaactctttttggttcctctagcaggcataatagattgtcccattatggtcccttcctctttccttcctaatgacatacagatgatgacttcattggtgtgtccactagtacccatgtgattcacgtaaatccagattagtaaacaaacccagtaatcccattccccctgacaattattggtgtaaaattgggtatgtagggttaagtttcatggttttttcttggagatgttttctgactcttaaaaagagaatcagagaacacgctgtttttctcttttcttttggatattttattatctggacacgcaaactggagttgctataccatattgtgacttggggcaagatagatgaaacgccaaaatagacaagctaagaatggtggggatgaaagatgtcatcaaagaacctggatgcttcatgggaattttgagttatgatattaattagctccatgcctgttctactcaggatatttactacagatttttacaaatgtctttattttaaagccaatatgaggacagacgcggtgtctcatgcctgtaatcccagcactttgggaggccagggcagatggatcacctgaagtcagtagtttgagacgagcctgactaacatggtgaaaccccgtctctactaaatacaaaaaattagccaggcatggtggcacatgcctgtaatcccacctatttgggaggctgaggcaggagaattgcctgaacctgggaggcagaggttgcagtgagctgagatcatgccattgcactccagcctgggcaacacgagtgaaattccatctcaaaaataataataaaaaatattttaaaagtcactatgagttatgaccattgatattttgtttataaatgcatttgaaagcatcccatgtcctttctctttagacattgtggtgttagatccaatcataatagagagcctgatggtttctaagcagtgatttatcttccactcttctctccattcatttgtacacattatatctattgttatcctcctttcagcctccactgtggaaattgctttgataacttattaatgccaaaggataaataaaaaatatatacccttcaagaagcattttcattctaaaggattttaaatcagaccttaaccctgaggaatgaaatatctaataaagtaaattacagaaattgcatcagactcatgagaagcacttctcattgtcctttcatgttctccttatttggtatctttatgcttagtccattacttaaccataaaacttcattctttcaggaatgctcaaagtactttaaagagaattaacctggatatagtgcaatctgctcagggctaataatattaaggattcacacacttggaaaatatctataaatgattttttaaaaagataaaaagaagtgtggctgtgtttttgtatatgtggacatacaactgttgcattttagcctggtctatagccaagattgagagtgatataatcatattacttttctaaattggggaaatatgtttcttctcttttaatggtaaaatggtcttaccatacataaaagattggtgatacagaatttcaggaactaatgattgactctgtattcattaatttgtttaacaaaattgtgagcacgtactggcaccaatttagctattgaggatacagcactgaacacaagcccttcccttaatggagggactttgtagtgttgtgaatagggaaaaagagataaaaaataagttcaatatattaaatgtcattgtgatttgtgatatggagaaaagatgcataaaatgtagaataggaagtgtgtgggtagggaggaacatttcattttttttaaggtcgtcaggaaaggatctattgaaacataacatttgagcaaacacctgcattagcatttgttttgcttagctgcgcaaaatgtttttggcatacagaaattcatgcttggaaggttgatgatagaaacttacttgttttaagaaatttctatgtacataatagaatattatctatgcatataaatgtctctattcaaatttcttcaaaggacctcagcttaaacacatttaaaattaaactcatcattttcttcgaaatctattactcttttctgctcttcttccccaaacaacttagtaagaacataggcaccactgcagttcaaaaatctgaacatcattatgaaagtcctcttctaattcaatacccaggctgactaaggtattgtctcattagggaaactgcattttctgctaccaaaatcccattgctaatagtgtctagtgcaaatacagctgtgaattcacttcatttatttattttcctgaggagggttttccaataacctccccccaccccgaaaattgttaaaaaaacactgtaacactatccttttcttacttttttgtacatttactttataaatgttgtcctttggtcagtgaaccaaaaccaacagaagaggacaaaatggtcttatgtgctattaccatgaataatgtcttccagaaatagacttgaaaattgctcccctaatgccatcccattcactatatacttaaaaaaaatctatgagggttgaaaatattgagatgattgatttaagatacctattattactgactgctgacatttggccttgggaaattacattcgcagtagtatttttaaaatgattaagagaggtttctgaaaaaaagtatttacattataagatgtatttttagaatttgtttcttaaaaaccattatataagctttctgaacaaaaaaagatatttattttatgagaaaaatacactgaatttgcccttataaattataatttgtaaaaattaataaatgtaagataagtagattcccaatagcatatacaaaataaaacttgcttacaactgatcataaaatgtaatgtgcccattgaatatggtaaaagggaagtatatgaatcataaaattttatttttcctatcctatccacaataccatgatgctatatagctattaaatttggaacagttttcaggaatatcttggtttattgggcttaatgatattgtgcttctcagataaagtaatttttacaaatttaagatttttgcaactctgcatcaaccaagtctattggtgccatttttacaatagtatgtgctcacatgacactttcaggtgtcacattttggtaatattcataatatttcaaactttttcattattattatatctgttatggtgatctgtgatcagtgatctttgatgtttctaatgtaactgctttggggtgccatgaaccatgccatgtaagatgacaaacttcatcaataagtgtgtgttctgactgctccctcagtcagctcagctgtttctccatctctctcccttccttaaggactccttattccctgagacacaacaatattgtaattagtccaattaatgactccacaatggcctctaagtgttcaagtgaaagagtcacacatctctcacgttaaatcaaaagttagaaatgattgagcttagtgacaaaggcatgttgaaggccaaaacagaccaaaatctacgtttcttatgccaaacagttagccaagttgtgaatgcaaaggaaaagttcttgaaggaaattaaaaaggctacttcagtgaacacaggagtgataagaaagagaaacagccttgctgttgatgtggagaaagtttgagtggtctggatagaagatcaaatcacccacagcattccctaagccaagtcctaatccagaccaaggcagttactccgttcaattcagtgaaggctgagagaaatgaggaagctacagaagaaaagtttgcagccagcagagtttggttcttaagatctaaggaaagaagtaatgtccagaacagaaaagtgcaaggtgatgcagcaactggtaaggtagaagcttcagcaagttattcaggtatagctaagataattcatgaaggtgaacgaaggtggctacactaaacaacatattttcaatgtagaccaaacatccttctattggaggaaaatgccatctaggaatttaatagctaaagatgaaaaatcaatgcctgtttaaatcttcaaagaacagtctgactctctttttaggagctaatgtagctggtgactttaagttgaagccaatgttcattgactatcctgaaaattctaaggtccttattctcagcaaactatcgcaaggacaaaaaaccaaacaccacatgttctcactcataattgggaactgaacaatgaaacacatggacacaggaaggggaacatcacacaccagggactgttgtggtgggggcggggagggatagcattaggagatgtacctaatgctaaatgacgagttaatgggtgcagcacaccaacatggcacatgtatgcatatgtaacaaacctgcacgttgcgcacatgtaccctaaaacttaaagtataataaaaaaaaggaaataagctcaatctactctgcctgtgctctataaataaaataacaaagcttggatgtcagcacatttgtttacaacatagtttaccaaatactttaagcccactcttgagacctactgctcagaaaaaaagatttctttcaaaatatcactgctcattgacaatgcaccaagtcactcacataagagctctgatgaagatgtacaaggagattaatttaatgctgttttcatgactgctaacacagcatccattctgcagcccatgcttcaaagagtattttcaactttcaagtgttatgatttaagaaatatatttttatatatttatgaagtatagctgccatagatggtgattcctctgataaatctgggcaaaataaattgtaaacctaggattcaccatcctagatgtcattaagaacactgttgattgatgggaggaggtcaaaatataaacattaaaagaaatttggaagaagttgattctaaccaccatggatgaccttgccggattcaagaattcaatggaagaagtaactgcagatgtgttggaaataataaaagaactagaattagaagtggcgcctcaagaagtgactacattgctgcaatctcatgacaaaagttgaatgaatgagaagttgcttatagataagtgaagtggtttcttgagatggaatctacacctgataaagatgctatgaatattgttgaactggcaacaaaagatttggactattacataaacttatttaatgaagcagaagcagaggcagtgtttaagaagactgacttcatttagaagttctaccatgtgtaaaatgccatgaaatagcatcataagctacagatacatttttctgaaggaagagtaaattgatgtggccaacttccttgttgtcctattctaacaaattgccacagtcaccccaacttacagcaaccacccttctggtcagacagcagtcatcaacatcaaagcaagacctcccaccagcaaaaagtatcactagttgaaggctcagatgatcttgttagcatactttagcaataaagcattttttaattaaagtatgtatattttgtagagatactgctattgcacacttaacagactacagtatagtgtaaacataacatttatatgcactgataaaccaaaatatttgcgtgactctctttatggtgatattaactttattctggtgttctggaaccaaaccagcagtattttggagataggcctttttgaaccaattcatcccaatttctccatcagcccacctttcaaatttgtgaatcatcctgaacctaatcttttattttccccttccccaggaggtatgctaaggcttttaaccctctatgcaaacttaaagcattctttttataaatgtttttgatgtctctgtaccaaatgaatgacctacattcaccaagtttatattctctacctgaatgtatatctttattttggaagggttggagttagctatttgctaacaattactctcactacaaaggcatttaatcaataaatattattaacctgctagtacaatcagaatattgttggagctgaataaaattattcttgttttcaaggttattacaatttaataggtggaaaaaacacatggaaataatattaatagcatcatgaattacatatgcatcaattgctagaaattagaacaagacgaaaatcttctgattagaatgatccagaaagcttaatagagggctgacatcagtgctgggtgttggtggtagggtatgattttaatatgtcaaaatggggaattagctgtgctatgtcatattgtatttgtctaaatgtacataaaactagtttcacaaattatcatgtattcaatttgaaaagcatcttgtaacttaaaacatattttcataggaatgtaagaaatataaaattataggcctagcataaatttgtgattatttatgtattaaatagttcccaattttacaaaacatttggcctccagtccttaaataataatccattgcaggataaatatatcattaaaaaatctaggtagcataaagttctagttattttaacaactatataaagaaatatatgcaaattataaaatgagctttataagaacttttctgacattataaaacttatcacatgaagtagcttttcttatacttgaggttttatttccttaaatgtacttagaaatacgaagcaatgcatctgttctttgaactgaatttgaagaaaaaaattaagaaaatgatattgttgcctaagttgatattaatattagtaattttcaaaatcgcattaaccagagagtagggtggttggaagtagtgtcactattcttttgtatgccatctgtaattcatggtttttgaacacatgcttagaactcacagtagtgatgagacttacaaacctagcttactatgattgatgacagcagagttaagcaaaattaaacaactgagaggaaggatatttttgtcacagggatggtaagaaaaggtttagttgttgccattgctaatgtttactctagttctctttttagatgacccaccacagtgtcctgagaagccaaaatgggataattggggtctaatggaaggccaacttagtaagacaaaggtctatctaaagggtctcaaatgagggtattagggatgtcaacaccaggctggaaacatattccaagcagtgattaggcggtctcttcttggaagtgaatatgaactggcattagattcaggcttgacagtgaaatatgtggagccttctgactcaacatgcagcacatattgtttattttctgttgctatggagaaaaaaaaaatgcacctagtcaactcctctccagtgtgttcaaaactatatgccagtgtttccaggaagcattagataagagtgggaggtggtgaggcaaacatctacagtgtcacactgtctttaagccaattttagagattgcatgactcctgaatcatcatagctcaacagtacggagcattcactttgtcagtgctatattctaagtgctttacatttactaacccacttagttctcataacactttataaaataaataatattaatattcccattttacagatgaaaaaaaatgaaggcatagagcaattaacaaacagccgaagttacacagttaaaatgtaatatgactaaaattcaaatcaggcacttttgctctagaaagaagagcaaagggaagtaatatatttttagtattctcagacttgaggaaatatatgcaaaaataatataataaattaaaagcaatacctgttatatgtctactatactggctttcactcacctggatgggattaatcagtatctacaattaattttgtgcaaatgtcatcgttatctcatgacattttcaaatttcctaaaacaacctctcatatcaaaagtaatgtttttaaaccaaactttattatttgtattaacatataagtatctgtttataaaatcaagtataataattaaatatacacagaactattgaataaagaacaaatgtaaggcacgaagctacagatttttaaacttaaatcctaaaaatttagtcaaattctcaaagtttacaaatgacaaacggaaaggtaatcttattggtagtcagataaactcttaatagctgactcagatcagtattgtttcctttataccaagctgtaggtacaaagtcttatttttcctacagtcatcatcaagttccagattgtaaactgcctcataaattgaacctcaccaacacagctcaagaccaatctccatgccttgtctcttgagacacacagtaaatgaacctcttctccttttccctttggtcatattttcgtctcctgcaagtatctaccatggtctcgcaaagatcctaatacttaaaaaacaaagagtgaaattatcaaggagagaatatagtagtagtgagagcttacaaaaattaaaaagagccaaacaaaaaagtgaataagtgctgatttataattgggtttttaattgttaacatttcaatctaaggtttagatattagatacagaaatatttatacattttcatagtttggaggaagggaaggtatagcacatcaagctgaataataaattaaaagtaataagtaatctctgaaatacacatctatataaaaagagagaaaaagaaaagatgatggtctttgtcttttgtttctgttttttaagcagtgcaacaatggaatagattatgtgagaatttctcttcctggtaaaagactgatttataggagatgataaacctctaaatgttgacatgttaactcctttcggatggtcaaagtgtcaaaatatgcctgccatttagatgcaatatccttccaccacattcctctggaatattaattgaaagatatatactggagtcgcctattcaaagccacagtcccgctgagaccttcaaggattcagcctattcagaaggctgaatatattgccctgaaaggttcctatgtcctactccctggacctaggaaaatattagattacatggcaaaaggaaattaaggttgtggaggtaattacggttgaaaatcaacaggccttaaaatagggagattaccttggattgtccataagggcccattgtagtcacaaaggaccttaaatgtgaacaaggaaggcagaagaggagaatcagaagagctgtgactagaattaaatcagagtgattcaaagtgaggagaatttaaatttctcctgggggtcacaagccaaggaatgtggtggcctctagtacctggaaaaggcaatgaaacaactcccccactgcagattacagaaaaaaatgcagcctacctacatcttgatttaactcagtgagaaccatatcagacttctgatctacagagctataagatttgttgtttttttgttttgttttgtttattatacttttaagttttagggtacatgtgcacaacctgcaggtttgttacatgtgtatacatgtgccatgtaggtgtgctgcacccattaactcgtcatttaatattaggtatatctcataatgctatttctctcccctccgcccaccccacaacaggccctggtgtgttatgttcctcttcctgtggccatgtgttctcattgttcaattcccacctatgagtgagaacatgcggtgtttggttttttgtcctcgcgatagtttgctgagaatgatggcttccagcttcatccatgtccctacaaaggacatgaactcatcctttttatggctgcatagtattccatggtgtgtatgtgccacattttcttaatccagtctatcattgttggacatttgagttggttccaagtctttgctattgtgaatagtgccacagtgaacatacgtgtgcatgtgtctttatagcagcatgttttataaccctttgggtatctacccagtaatgggatggctgggtcaaatggtatttctagttctagatccttgagcaatcgccacactgacttccacaatggttgaactagtttacagtcccaccaacagtgtaaaagtgttcctatttctccacatcatctccagcacctgttgtttcctgactttttaatgattgccattctaactggtgtgagatggtatctcattgtggttttgatttgcatttctctgatgaccagtgatgatgagcatttgttcatgtgtctttcggctgagaagtgtctgtttgtatccttcacccactttttgatggggttgtttgtttttttcttgtaaatttctttgagttctttgtagattctggatattagccctttgtcagatgagtagattgtaaaatttttctcccattctgtaggttgcctgttcactctgatggcagtttcttttgctgtgcagaagctctttagtttaattagatcccatttgtcaattttggctttggttgctattgcttttggtgttttaaacatgaagtccttgcccatgcctatgtcctgaatggtattgcctaggttttcttctagggtttttatggtattaggtctaacatttaagtctttaatccatcttgaattaatttttgtataaggtgtaaggaagggatccagttacagctttctgcatatgactatccagttttcccagcaccatttattaaatagggaatcctttccccattgcttgtttttgtcaagtttgtcaaagatcagatagttgtagatatgcagtgttatttctgagggctctgttctgttccattggtctatatttctgctttggtaccagcaccatgctgttttcgttactgtagccttgtagtacagtttgaagtcaggtagtgtgatgcctccagctttgttcatttggcttaggattgacttggcaatgcgggctcttttttggttccatatgaactttaaagtaggtttttccaattctgtgaagaaagtcattggtagcttgctggggatggcattgaatctataaattaccttgggcagtatggccattttcacggtattgattcttcctacccatgagcatggaatgttcttccatttgtttgtatcctcttttatttccttgagcagtggtttgtagttctccttgaagaggtccttcactcccttataagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcctatcaccttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtggcagttttcaaagggaatacttccagtttttgcccatttagtatgatattggctgtgggtttgtcatagatagctcttattattttgagatacgtcccatcaatacctaatttattgagagtttttagcatgaagggttgttgaatttgtcaaaggccttttctgcatctattgagataatcgtgtggtttttgtctttggttctgtttatatactggattacatttattgatttgtgtatgttgaaccagctttgcatcccagggatgaagcccacttgattatggtggataagctttttgatgtgctgttggattcagtttgccagtattttattgaggattttggcttcgatgttcatcaaggatattggtctaaaattctcttttttttttttgttgtgtctctgccagggtttggtatcaggatgatgttggcctcataaaatgagttagggaggattccctctttgtctattgattggaatagtttcagaaggaatggtaccagctcctccttgtacctctggtagaatttggctgtgaatccatctggtcctggactttatttggttggtaagctattaattattgcctgaatttcagagcctgtttttggtctattcagagattcaacttcttactggtttagtcttgggagggtgtacgtgtcgaggaatttatccatttcttctagattttctagtttatttgcatagaggtgtttatagtattctctgatggtagtttgtatttctgtgggatcagcggtgacatcccctttatcattttttattgcatctatttgattcttctctcttttcttctttattagtcttgctagcagtccatcagttttgttgatcttttcaaaaaaccagcttctggattgattgagtttttgaagggttttttgtgtctctattttcttcagttctgctatgatcttagttatttattgccttctactagcttttgaacgtgcttgctcttgcttctctagttcttttaattgtgatgttagggtgtcaattttggatctttcctgctttctcttgtgggcatttagtgctataaatttccctctacacactgctctgaatgtgtcccagagattctggtgtgttgtgtctttgttctcgttggtttcaaagaacatctttatttctgacttcatttcattatgtacccagcagtcattcaggaacaggttgttcagtttccatgtagttggcagttttgagtgagtttcttaatcctgagttctagtttgattgcaaaatctgtggtctgagaaacagtttgttataatttctgttcttttacatttgttgaggagtgctttacttccaactatgtggtcaattttggaataggtgtggtgtggtgctaaaaagaatgtatattctgttgatttggggtggagagttctgtagatgtctattaggtccgcttgctgcagagctgagttcaattcctggatatccttgttaactttctgtctcgttgatctgtttaatgttgacagtggggtgttaaagtctcccattattattgtgtgggagtctaagtctctttgtgggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcacagactaggattgcaacccctgcctttttttgttttccattggcttggtagatcttcctccatccttttattttgagcctacaagtttctctgcacgtgagatgggtttcctgaatacagcacactgatgggtcttgactctttatccaatttgccagtctgtgtcttttaattggagcgtttagcccatttacatttaaggttaatattgttatgtgtgaatttgatcctgtcattataatgttagctggttattttgctccttagttgatgcagtttcttcctagcctcgatggtctttacaatttggcatgtttttgcagtggctgatactggttgttcctttccatgtttagtgcttccttctggagctcttttagggcaggcctggtggtgacaaaatctctcagcatttgcttgtctgtaaaggattttatttctccttcacttatgaagcttagtttggctggatatgaaattctgggttgaaaattcttttctttaagaagtttgaatattggcccccactctcttctggcttatagagtttctgccaagagatcagctgttagtctgatgggcttccctttgtgggtaacccgacatttctctctggctgcccttaacatttttccttcatttcaactttggtgaatccgacaattatgtgtcttggagttgctcttctcgagcagtatcactggggcattctctgtgtttcctgaatttgaatgttggcctgccttgctatgttgcggaagttctcctgataatatcctgcagagtgttttccaacttggttgcattctccccgtcactttcaggtacaccaatcagatgtagatttggccttttcacatagtcccatatttcttggaggctttgttcatttctttttattcttttttctctaaacttctcttctcacttcatttcattcatttgatcttccatcactgatactctttcttccagttcatcaaatcggctactgaggcttgtgcattggtcatgtagttctcgtgccatggttttcagctccatcaggtcctttaaggacttctctgcattgattattctagttagccattcgtctaattttttttcaaggtttttaacttctttgccaagggttcgaacttcctcctttagctcagagtagtttgatcgtctgaagccttctctcaacttatcaaagtcattctccgtccagctttgttctgttgctggtgaggagctgcgttcctttggaggaggagaggcactctgatttttagagtttctagcttttctgctctgttttttccccatcttcatggttttatctacctgtggtctttcatgatggtgatgtacagatggggttttggtgtggatgtcctttctatttgttagttttccttctaacagtcgggaccctcagctgcaggtctgctggagtttgctggaggtccactccagaccctgtttgcctgggtatcagcagtggaggctgcagaacagcggatattggtgaacagcaaatgttgctgcctgatcgttcctctggaagttttgtctcagaggagtacccagccgtgtgaggtgtcagtctgcccctactggtgggtgcctcccagttaggctactcgggggtcagggacccacttgaggaggcaggctgtctgttctcagatcttcagctgcatgctgggagaaccactactctcttcgaagctgtcagacagggacatttaagtctgcagaggtttctgctgcctttttttggctatgctctgcccccagaggtggagtctacagaggcaggcaggcttccttgagccgcagctgggctccacccagttcgagcttcctggccactttgtttacctactcaagcctcggcaatggcgggcacccatcccccaacctcgctgccgccttgcagtttgatctcagactgctgtgctaacagtgagtgaggctctgtggtgtaggaccctctgagccaagcacgggataaaatctcctggtgtgccatttgctaagaccattggaaaagcacagtattagggtggaagtgacctgattttccaggtgccatctgttacccctttctgtgactaggaaagggaattccctgaccccttgcgcttcccgggtgaggcgatgcctcaccctacttcaggtcacactcggtgcactgcacccactgtcctgcacccactgtctgacactccccagtaagatgaacccggtacctcagttggaaatgcagaaatcactcatcttctgtgtcgctcaggctgggagctgtagagtgcagctgttcctatttggccatcttggctcctccctcctattgttgttttaagccaccaaatttgtggcaatctgttgcagcagcaatagaaaatgaatatacaagcctagaatcatcatttagtctcttagagccattatttagtctcttagcaccagagactaaattaataaatattcgtgattccccaagtttatgtggttttgctgtatgtaatagactatcttaataaaccttttgaaatactcctatgttttaaaaatcaattccagagtcaaaaaatatgcacctcaattctgtgggccatcactaaccaaggttggctataatcattccattatatctttaagactacataaccaagttattttcaaacctgtcagatcaatgcttctaaaaaagtcaggaaacaacaggtgctggagaggatgtggagaacaaggaacacttttacactgttggtgggaccgtaaactagttcaaccactgtggaagacagtgtggcaattcctcaaggatctagaactagaaataccatttgatccagccatcccattactgggtatatacccaaaggattataaatcatgctgccataaagacacatgcacacatatgtttattgtggcactgttcacaacagcaaagacttggaaccaacccaaatgcccatcaatgattgattggattaagaaaatgtggaacatatacaccatggaatactatgcagccacaaaaaaggatgagttcttgtcctttgtagggacatggatgaagctggaaaccatcattctcagcaaactatcgcaaggacaaaaaaccaaacactgcatgttctcactcacaggtgggaattgaacaatgagatcacttggacacaggaagaggaacatcacacactggggcctcttgtggggtagggggaggggggagggatagcattaggagatatacctaatgtaaatgacgagtgaatgggtgcagcacaccaacatggcacatgtatacatatgtaacaaacctgcacgttgtgtacatgtaccctagaacttaaagtataataaaaaaagaaagaaatattaacaccatgtttattaattaaaattaaagacccagaacatatgtcattaactgaatacttgtgcctactaaatttcatacattgaaatttaatccccagtgaaacagaatttggaggtgggacctttaggatgtaattagttcatgaggtttgagctttcccaagtaggattaatgcccttattaatgaggtcacagagagctctctttctccttctctttcttttatatgagaatgcagataaaagatggcagtctacaacccagaaaagggccctcatcagaacctgaccatgagggcaccctgatctcagacatcaaatcttcagaattgtgagagatacatttctgtcgtttatgtgccaccaaagtaccagcattacttttctttataccaagttgttacagtatcttgaactaagacaatataaaacctacctatacacataaattcaaaaaatatataatcccctatagataagataaatagcagggaagtcaagataatataataatgtacatttatattccggcaagactacactagaagacacaatgaattaataagtttgtccccataggtagaatcacagtgagtacttcagactgaaacagttatgttgcattggccactcgaatactgagaatggagtggatattgtgtaatttcgaacaacacttgtttaaattccaaacaaaatgttatagaatctcatcatttgtgcagcaattcctttacttcaaaatgctgtgtatgccaaatcctaggtaatctttacttgtgcagcactgcctaagttgcaggatagctagaattcctgaccccctcctctaaatgccgacaccctactcacctcctgccccaccaggcattatgataattttaaaagacccagaaatccctttacaaactctttatcttttaactactactaactcattcttcaagttaggagtcaccccctccaggaggacttcaccgactactcaccaggctagatgaggcctttcatacctgtcagcacccagaaacctctgcttttctctattactgctaacagtaacgaataagaatgtcatataagcaatgatgaacattaccctgaaagtttaccacttgctgggcatgctgagctctcctgtgaattatctcatttatctcacgcctgataaaaatagtttggttataacagttagacaaggcagtagcttgaaagacagtttatgtgcagaaagaagagattatgattttgttttgttttattttattttaaggtagaggaaatcaagcttgtgtgtatgtaaagacaagacaacagtggttctgagagagagctttatgttacagaaatgagaataaattcccagaaaagataaaagagagagggtaaccttaaaccaaaagaagattccctctctagtgtaacagcagcaattggagatagactgtaagaatcagcctcagaagctgttttcagcataatacactgtgtgagtaggtgtgattgaaagagaaggagcaatgggtgtcagtaaaagagaatatgattaaaaaatcagttgtggggtttgcagcagtagggaagaaataatgtgatataggggctagaaaactggctgtaaaaggaggattccaggtttgaagtcttacatagagaaaaagatcaggtttagtgagtcaagtttagagttgtatgagatggctgaagccattagtgcaggtgtagcttttgggatgacaagtaaaggtcatagcccatgtgtggagaattgactctgttaaggtctttgttatgaaagaggtacaggaaattagggcttttgcatgttggttgattatgaacaaaattatgaccaatgatcataaatagaatgaataggagatggcagaacacaaattttaaactccaaaagagtaaagtttgccttgtcctatatgtgctttctagagagttctataattccatgtgaatggcaatacatgtttttaatggccaatagtaatatttcaatagatgctagcatttcatttaataatttttatttatctgatggtcacaggaatcaataattagaagagaacattgcttaatagttaattaagttcctttaataatgtgacagttagacaagttgtctaaaggtgacatctccctgatctataaattttcaggctcatgggaacattgggcacatcttttgatacactgcagcttccttatccttgacactacctagtctatttagaaaatgtcaatcagtcatcaaggcaagatatcaattggatgactatgataattactccacttatacatatttttcctttcaattttcaggtatagatgcaaaaatttattgtactggtgtattttttcagactctacaattctaaatctcagggtagtgtctgtagtttcagttatattctaaatgaattgtttatttaatgctagttaatttccaaccacttttatcacatctctggttaaaagttcattccataaaatacattagctaaatttcctttcatattaggtagaataatacatcaggaaaacagtccaaaaatgtttcatagaatttttaaagactaatttaggttcatagcaatattgagcagaaaatacagagatttcccatctacccactgccctcacacacacatagcttcctccaacatcaacatcctatgctgcagtggaatgtttgtgaggttatcaattgtttatttcatagattgtggctttggtatagttacagttgatgaatctacattgacactttgttattacccaaagtccatggtttacattaggggtcactcttgtaccttctatgggtttggacaagtgtataatgacccctttagtattatacagagtagtttcctgccctaataatcatctaggctctgcctattcatccctccctcccacaaacctgtggaaaccactgatctttttactgtctccatagtttcacctttccagaatgtcatatagttggaatcacaaggtatgtagccttttcagattggcttctttcactaagtaatatgcatttactcttcctccatacatattcatggctcgatagctagttacattgtattggttggtttgtttgtttttcacagataaggtcttgctctgtcacccaggctggagtgcagtggcacaatcatagctcactgcagccccaaacgcctgggctcaaacaatcctcccacctcagtctctcgagcaactgggactacaggcatgtgccaccatgactggctaattttttttttttttaattagtagagatggggctagcttcaagcaatcctcccaccttggcctctgaaagcactgagattgcaggcatgattcactgtgtttggcctagtttctttttagtgctgaataatatttcattgtctggatcaatcagtttatttatccattcacctactgaaggacattctatttccttctaagttttggcagttatgaatatagctgttataaacatttgtgtgcagatttttgcactaatgtaagtttttaattcttttgggtaaataccaagggataggattgctggatcctttggtaagaatgtttagttttttaaggaactacttgttgtcttccaaagtggctgtgccattttgcattcctaccagcaatgaatgagagttcctgttgctctgcatcctcttcagtatctgatgttgtcagtgttctagatttttagtcattctcatagatgtatagtggtatctcactgctgttttagtttgcatttccctgaggacttatgacatgaagcatctttttcatatgcttatttgctctctgtacatctttttggtgaagtgtttgttaaggtctttggcccatttttaaaatcagattaaagcaaagacattcttattgttgagtactttgtacattattcttgatatattttggataacaggcctctatcagatgtatcttttgatgcatttctttcagtctctggcttgtcttctcattctcttattctcttgacattgtctttcacagagcagaagttttaaattttaatgaagcccaggttatcaattgtttatttcatagactgtgcctttggtgtggcatctaaagagtatcactgaatccaagattatctaggttttctcctatgttttcttctaggagttttatagttttgtattttacatttagctccgtgatccactttgagttaattttcatgaagagtgtaaaatctgtgtctagatagattatttttttttttgccacatggatgtccatttgttccagcaccatttgttgaaaagattatttttttctccattgtgttacctatactccattgtcaaaaattacttgactctatgtaggtctatttctgggctctgtattctaccagattgatctatttctctcttctttggccactaccatactatattaattattttagctttatagtaagttttgaagtcaggtagtgttagtcctctaatcaattgttttaagtattggaaatcttaaagtatgcggagttcataatgaaaataaaccaagaataaaggaatctttaagtgtatgtgtaaatgattaaagatatttggagaatgagactaaccatggaacactaatagggagctcattatttgattggcttttgatattagcataatattttatttttcatgggaactatattagagaaagaaaacaaataatagatgatactaattagctattgattttcaattaatctatgtattatcatatttatacatttctaggccttttctgaatcttatttcattatatcatatgttctaaatgaaaaatattaggtttgcttaagaatctttcttttccttgaatgaatttgtttcttggactgtttttgagctccttgaactgcaatcagtacttatgaacttatgtaaagaaatgttgttagttttaacatcactgtacgaatccaaaccatcaattatttgaatagtttagagggatatgtatttacataaacatattcacagaataaggccttataaaccaccctaggtaatgtcttttttaacataggtacaagaaccaaaccattgaagatttagaagcaatgaaaagttatcttattgtttgcctagataacttcacttaggaaatgtgagaaaatactggttacttcatttttaaaaataacatgaaccacgttgttttcattttggaaattttatgaaaatacaatagccagtaatgtgcccaaatatttttattttaaaatattgtttaataaaatatctacttgtttatttttccaaaaggataactaatttggaaattacaaatcccttcctctctaaatcatttgggtcaccaaacaaaaatgtttttcctatattctgtacataccttttcttattttcagaataatgactttgttagtccttacagttgcacgcgcgcatgcacgcacgcgcacacacacacacacacacacagacacacacaaacacgcacactagcagagaaatccagagacaaaggtagaggtatattctctctctctctctctctctctctctctccctctctctctctctctctcacacacacacacacacacacacacacacaccccacatgtaagatgcaggacacagtgtgctacatttatattaggaaactacaaattgtaacctcttatccctgatggtaggccatatttagcaagacagtgaagctggtaaatttctataacacctgggcagagttccaatgggaatatccacatgtttaagagacagacaaggaacctcatttaaccttgttactgccaatatgaacaagcagagaagcaaaaacaatgtgttctggacttttaaatggctacagcggggtagctattttcattattattattattattattattgaattttatttatttatttatttaaagacagagtcttgctcttttgcccaggctggagtgcagtggcacaatctcagctcactgcaacttccacctccccggttcaagcaattctcctgcctcagtctcctgagtagctggaattacaggtgcatgccaccacatctggctattgttttgtatttttagtagagatagagtttcaccatgttggtcaggctagtcccaaactcctgacttcaaatgatccacctgcttcagcctcccaaagtgctgggattacaggcatcagccaccatgcccagtctattcctgaattttaaatttagagtactgctgttcttctctgggcctaggtcagacactttgagagctacattaagacttgcagacctcttaagggacccttaaaagcctttcagtggcaatttactaaatggtttcccttagcggaatgaaagtttcatgtctccccaagtgcctcagcctctcagggctcagagggaaaaaagtgttctttctgtttgatgatgatagtaccattattttccattgctttttcagatgccaatattacatcaaggtatcatgatgtaatgattctactttcatttcagataaattagtgcctctagtatcctctctctgagatgaaggaagaggtaatagtcttgctgaatcaatcacagataatagaaatgctagtgaaattacccactgaggctttcccaacctctctactgaatgaaaagagccctgaaaagcagtccttgctcaaaatgttcaaaatgttaccacacttttctggatcctagctttctcaaatgaaaagtaaaatcattgaactgaatgactgctatggaaaattctaaccaaagcattccctgatttttaggttattgaatatcacagtcagcaatgtcacgagggaaagggaatcttccagattatcacaaataaaaaaattcattaaaaatagatacatttttcattcttagattttctatttctcaaaaccacaattctagtacaatatccagatttttaccataattgcataaggagatgtctccttaagtaacccacatctgacattaaccaaattcatcactttcttcatccctaagtaacctccccctactaccttctgttatttagattatggtgacagtacagaagttctatcagtgtaggtataaagaatgaaattaattagtcatgacaaggaaagttacttggaaattctggcctgtggagtgtttgagttaaaacatctaagagtaatctgaaattggagctcagggcagatgtggtggtgaaatacttgtgggaacctctgtcatggaaagttatggatgtggaatgactttatccaggaaaagaaagacaaatggtaaaacaggtaatatagcaaaaaggcaggatatttttttccaagtaatagagaacaatagaaattgaaatgcagatatatacagtgtataaacttctaaaagctaaaagcctgaagccctctaacatctaagctgtcaagaccagtcatgcacaagaagaaattcaatcctcagggctgtgtttcccagctgggttacctcacttggattctggccaagttggtagctctgaagacaatcaaaatatatgcaaattaagaatttgatgctcaaacaccctgtttatttatttaaagacagagccttgctctgttgcccaggctgaagtgtagtggcacaatctcagctcactgcaacttccacctcctgggttcaagcaattctcctgcctcagcctcctgagtagctggaattacaggtgcatgccaccacatcaggctatattgaagctgtggagcttcaattgttttgtctcattttgctaaaatatgttttatttcttggtgattccatatttaaatttcagtaagtcattctatagtctaaagatatatttaaggtataatttagttaaatgaatagagactttgaaatcctgtggtccagcatactatgctggctcttccccttaaggagctatatgactttataatttttatttgactctatatgaaacaattaaaaaaaaaccaaacaaccaaatgtcattctgtgtctcagtatcttgtggatgatatagctattccctgaattatgatggttcaacatatgactttttttttttactttataacgagtttatcagagtgttaactgtactttggacctatgatttttttttttatttgacggagtctcgctctgtcacccaggctggagtgcagtggcacgatctaggctcactgaaaactcctcctcctgggttcacgacattctcccgcccccgcctcagcctcccgagtagctgggactacaggggaccacaaccacacccggctaatttttttttgtatttttagtagagacagggtttcaccatgttagctaggatggtctctatctcctgaccttgtgatccacccgccttggcctcccaaagtgctgggattacaggcatgagccaccacgcccagcccggacttatgatatttttgacttgcaataggtttatcaggacataacctaactgtaagttgagaagcttctgtaatggtatttgcctcattgagattattgaggcaattaaaaaaggcagtgcatgaacagggacttgcacatagtagataattaaaaaaatagttattctaaattgctctatcacagtaaatacacatagtgacaatgactttcacaaagactgaaatctataatttatttaatctgacttcccattcaagagaaattcagctgatcaaataggaatgtcaatgaataacagtttgtgtacataatcatgcacagggagaaaggcatgaaacacacaggggcaagcagcaaaactccagctgttattgtattggaacagggaattagaacatggattgtctaggtgaagctataatttctccctgtcaaattgccacttagttagagtttttaaactaggatccctaggtgaggttgaagttgtccatgaatcatgaaattatgtgcaaagttctgtgttaagctatgcacattttgtcatggcaaacagtccataatttacatcagaattacatactaaaggaacagttgctgactgaataaactaaattagaatagctctagaacttttgtattatccaaaataaaattagaagaatatcttaagtgaaaaggcaaggaactagagaaagaataggtgtttaatatttccctcaaaataaacagtacatttatctgcttcattatttgtttaccttaaaagataacgttacctcttacaaagaggagctgctaccattccttctgaaactattccactcagtagaaaaagagggaatactccctaactcatttaatgaggccagcatcatcctgataccaaagcctagcagagacacaacaaaaaaagagaattttttagaccaatatccctgatcaacattgatgcaaaaatcctcaataaaatactggcaaacagaatcctgcagcacatcaaaaagcttatccaccacgatcaagtcaacttcatccctgggatgcaaagctggttcaacttacgcaaatcaataaacgtaatccatcacgtaaacagatccaaagacaaaaaacacatgattatctcaatagatgcagaaaaggcctttgacaaaattcaacagcccttcatgctaaaaactctcaataaactaggtattgatagaacatatctcaaattaataagagctatttatgacaaacccacagccaatatcatactaaatgggcaaaaactgaaagcattccctttgaaaactggcacaagacaaggatgccctctctcaccactcctgttcaacacagtgttggaagttctggccagggcaatcaggcaagagaaggaaagaaaggggattcaattaggaaaacaggaagtcaaattgtccctgtttgcagatgacatgaccgtatatttagaaaactccgtcatctcagcccaaaacctccttaggctgataagcaacttcagcgaagtctcaggacacaaaatcagtgtgcaaaaacacaagcattactatacagcaataacagacagacagccaaatcatgagtgaacacccattcacaactgctacaaagagaataaaatacctaggaatctaacttacaagggctgtgaaggacctcttcaaggagaactacaaaccactgctcaacaaaataaaagaggacacaaacaaatggaagaacattccatgctcatggataggcagaatcaacatcgtgaaaatggccatactgcccaagataatttctagattcaatgccatccccatcaagctaccaatgactttgttcacagaattggaaaaaaactactttaaagctcatatggaaccaaaaaagagcctgcattgccaagacaatcctaagaaaaaagaacaaagctggaggcatgacgatacccgacttcaaactatactacaaggctacagcaaccaaaacaacatggtactggtaccaaaatagatatatagaccaatggaacacaacagaggcctcagaaataagaccacgcatctacaatcatctgatcttcaacaaacctgagaaaaacaagcaatggggaaaggattccctatttaataaatggtgctgggaaaactggctagccatatgtagaaagctgaaactggaccccttccttacaccttatataaaaattaattcaagatggattaaagacttaaatgttagacctaaaaccataaaaaacccttaaagaaaacctaggtagtaccattcaggacatacgcatgggcaaagacttcattactaaaacaccaaaagcaatggcgacaaaagccaaaatagacaaatgggatctaattaaactgaagagcttctgcacggcaaaagagattaccatcacagtgaacaggcaacctacagaatggaagaaaatttttgcaatctgcctgtctgacaaagtgctaatatccagaatctacaaagaactcaaacaaatttacaagaaaaaaccaaccccaccaaaaagtgggcaaaagatatgaacagacacttctcaaaagaagacatttatgtagccaacagacacctgaacaaatgctcatcatcactggtcatcagagaaatgcaaatcaaaaccacaatgagataccatctcacactagttagaatggcgatcattaaaaagtcaggaaacaacagatgctggagaggatgtggagaaataggaatgcttttacactgttggtgggagtataaattagttcaaccattgtggagcacagtgtggcggttcctcaaggatctagaactagaaataccatttgacccggtgatccctttattgggtacatacccaaaggattataaatcactataaagacacatgcacatgtatgtttattgcgggactattcacaatagcaaagacttggaaccaacacaaatagccatcaatgctagactggagtaagaaaatgtggcatgtgtacaccatggaatactatgcagccataaaaaaggatgagttgatgtcctttgcagggacatggatgaagctggaaaccatcattctcagcaaactatcacaaggatggaaagccaaacaccacatgttctcactcatgggtgggaattgaacaataagaacacttggacacatggcggggaacatcacacagcaaggcatgtcagggggtgggggctgggggagggatagcattaggagaaatacctaatgaaaatgacgagttgatgggtgcagcaaacccatgtaacaaacctgcacattgtgcacatgtaccctagaacttaaagtataatttaaaaagataaagtcacctctttcagataaaaactgctgaggctaccacttaaaaaaacaaaagataatcactgtaagtttgggctttaaaacagttaaaagttctgtcagtatctgatacttcttagttagaaaaataatagtcgagttgctttttactattgttgtgaaaaaaagttgtgtgatatttagactcgtgatgtttgccatggataagtggctgtgttatcaattaagttgtctctgcaggatgaccacacattgcacactagagtagcattttctgttttttttttccatctttttttatcctatgctatttcactgaaataaatgtgaaactgaattcactgcagttcttaacatggaagtttcttctttctcatcaagaccacacagagacaacaagcttagaaggaaaagtaaaacattaccatttgcctaggcctgttcataactcagcacctattggtttcagcaggctaaagactaaaagcactatcaagctagcaaggaaaaatcactgtaatgtgtttagatgtgtggtcttgtcattttttcctgacttgctctataaaagtaattatagttttaggcataatctcccaattttaggcttgcttccattctctctctctctctcttacacacacacacgcacacacacatgcactttatctctcaataacctcatcaaaacagcaacaaggcagaaagagacaggtgagttctgagtaaaatatttgattaattgaccccaaaatatttttcctactttctctctttttaccagaaatcatatataccctggatcaaaatatgttaatcactcatattctcttaaaatcctaatatgttcccagtatttaataatggaaacattgtagagtcattggaattttcatatgtgataaaatttttagttgctgtaagaacttcagaacctgtgaaaatattcttttgcatgtaaaattatactaccagtatactagccattagtagatccctccaaaaattctcaggccagctcatccgcaaggagagatcttaacaacatctcacttcaaagctatcacactggaaacagttggaggagacaaaaatgcacttcactggcaattcctgatctgagaaatggccaattcatagagatgttgaacaaacccctttctgtcatgaggtctgtgaccaatttaagaaaaaggcatacatacacaagatgaatgtcaaataagtattccagccagtgactgttattggggactcctaacttctatatgggttagagaagttaggaagcacttcctgcaaaaatagtatttaaacatggttttgcagaaaggctaaactttaaatagcaaaaactgttgtctgtgaagaaaaacagtcagaagttgggtgggaagaatccaaaaagtgaagctcaatcactttacttctctcctataggattgaaatataaaggatatgggagattgagtaaaagtttggaagaatatatattttttttcctatttatgttttctagtctctagccaactatcagaaaaagctgaaaatggaaaatgcttctgcaaattagaggacaggtgaagactcaaattgggtagtccaccttggagagtaggtgggcacatctggattttgttgtgtgtctatgtcatttgacttgtcttaatgagtaggtgtttcttttatggtttggaacaaaaaaaatctaatgaagtgttttgtcacacagtaatttcaacatccttttccaataatgaatagattctactgaggctcagatgctagaagacaatcccaaatcatcagcaagcagcccatgtgaaagctccggttatacaactaggaaggaaagttttactgtggattctgccattgacctttggggcctgtgtttctcacctgtaaaatcagaagctaggagatgacagctaaaatctaggaaatcaaatcataatttttgttacaaacatgtataaactttaaataaatcagattggagtaagggcctaagatgtgttcctgtgaggaaagcacatgatcttttgtacacggactttttgatatttgttttggctgcccagagtcctttagaaacgctgtctgagctccagttattcatgattagttgtattcaggcattctaactactgcactatttttgtttgtttaaaagggctaaagaaagcatttatacgttctgacaatgcatctatattttccaaatattaagtgagaaagaatggaaagtgtgcccttatgggctggattgtgtcctcccaaaattcatatgttgaagtcctaatctcctaatatggttgggctgtatccccacccaaatctcatcttgaattttagctcccataatccccagtgttgtgggagagaccaggtggagataattgaatcatgggggtggtttcccccaagcctgttcttgtgatagtgtgttagatctcacaagatctgatggttttataaggggcttcccgcttcactgggcattcattctctctcttgccaccctgtgaagaggtgccttctgccgtgattgtaagtttcctgagtcctcccaagccatgcaaaactatgagcaattaaaccaccttcctttataacttacccagtctcaggtatttcttcctagcggcatgagaatggactaatgcttccccagtacatcagaatgtacctgtatgtggagataaggtctttgaagaagtaactaaattaaaatgaaattgttaccataggccctaatccaatatgaccagtatacttataagaagaggtcatttggacacacaaagagacgtcatggatgtgcacacagaggaaagaccatgtgaggacacagcgagaaggcttccataagccaagggaagaggcttcaaaagagacaaaactggccgacatctttatcttgaacttttagcctccaaaacagtgagaatataaattcctgtcgtttaagacactcagtctgtggtattttcttgtagcctagtaaactaatacatgtgcctttctcatcttccatttatctaaaatagttgagaatattgctgcttcttattgggtacttctatgattgctgaccaagaaaaagtgacagaatgtgtctttatttttcctgtgattaagatagaacacttatttataactttgcaatccactcttcagattcaagtgcttgagaggcaccttctccaagtgtttgttaaaactccagcgaatacacatgtacacagttttgatatagtggcaaaaaatttaggttcttttgtgatcagatttcacttctattcttaataatcagtgaaagtagacgtgtgcttaagctcattatttctagtgatcagaagcaatctgaacccacataatatcaacaaaagtaaactaatccaatcaaatatctgtccaattccacagggaaaaacagttacagtggttatacagtaaagtatgaaattttaaaaacatggttgaatatctttcaactaattatttcttatagttcgatataagtggcatattgttccctacttttcatccctttaggagtttaggaaggcaggaaaacacaacctataatattgtaggtgataacccaagtgtaccctgttataatatctgatgcagtctgaatccatttgctgttttagtattgccaagcataccttttccaaccaattttcttccattctcagacatcccttcaagtatatactttaagatatatatggatcgtagatgttctaatggctagaacaattgccagtatgtttccatcacttctctgaataaatcacattaaaaagtcataaaatgctgctatctagtgataaatagaagcaagacaatttgcctgcagtgtttgttaaaagattatgtaatctggcatctaatttttacagatgaatattggatgaaagtggatgatggcatatcttgcagggagcttttttaatttaatatttattttatgctctttctacagaatatttaaaatggactctaaacatagcattgaatggttgaatttgttatagggaaaatcagatacaaggcttcctgtatccaattcatagctgcaattcttgcctacaaaatctttactgccagaaaaaccattaaaacagtaatcaattgtggagtgtcatgcccaacagaatagcataacacaaaatgaaactttgccagttattgaaaacatgccccaatatagatttttaaaatatgactaattgtatgataaaatttccatattagttactgtttgaagctacaatgttaagcattcttagagaaacagaatggctcctggttttccttttgatcagtatgacaaaatacggtgtttattattgaataggtttatttccattttcaaaaatagcttttgaatagcttcttcacattcaaagaaaagtagatcatgagtagataatataacacaaaaacttagccaatcaaaccttacaagaaatgagccctaaaatgatgtttcacaaaattattcaaatgaattcaaaactcaagtggaagtgatttttgaaatatactttccagacagaattgacagaatgacaagtagaaataacccagctgccaataattttctaagtggtcagaccaaacacttccttgatctttacaacaactctgtgagatagataagacttttgtttttgttttatagatgtggctacccagagaagataagcaaattaccagtgtctaaagtgataccgccagcaagtggcagtgccaagattacagcaaaagcagtctgcagtctgggtggcgcttacacactcttaatgattctgcttgtaatgccattattcaactttccagttaggaacatgaaagaaagtctgtgcttttgacacactaaaaaggtcttactaataaataatggtattgttagaaattagggagccagccatacaggtgacaaagcgtctatgaactactgttctgtggtctgctgataaatgattattcaaaatgtattaataatacagggagataaattacatgtcataggctcacagaagctaaatatatcaacctttttaaaaaaatgattcacttgagctaatgaatgctttagctgtaagaactggcaacaaaatgtaaatagacaactttctcagataagacatgtacagataattgaaagagcagtaacaacaaaattaaagacacaactttaaaatatgataaaataggtacaaaatgactttcatacttaattcacaaatgtaagcaaagaggaatatggctttatagttataaagttacccaaagaccgcatctaaacagtgatttactttagttaaaatttatcagataatactattttgctggtggggagcaggcagagtaataagaggagttacccacatctcagcaaatatgcaaatctttattttgctttgctatattttcaggtatattacctgctattaacattgcagattttatacactgaaggcttattaaaagccattgaaaatgaagtataaagtcttcctgtttgagcatataacctaaatcaaacaggcaataaaagcaagccaaatatttgattactagtatatttttgagaccagtgtttgaagtgtgtagatgcttaaaattaaatgggtacctttatttgtgaatctaacctactatctaacaacttaatatgtaattttaatcatatctcttcaaaattaaaaacattcatgtctttaactctagaattgtttttctagaacttattctccaaaaagaattgtaaaattaattagttatgcaggagaataattttgtagcattgtttctaatagcaatgaattagagtcaatctaaatgccaataagttaaataatcatttattatgttgtgtagaaacacaataaatttctgcaccattacttaaaatattaaggtagttctcagactaatggtaagatgtccataatatattcttaactgaagaaaactagtgtcagagtaatgtggacagcattatcaaaattaaaaaaaaattgtgcagattttataaagtttttgtacattgtacatgagtacatagccaaagagactggaagaatgtagataaatcaattaacagttgttatctggtgaatgaaactattggagtcagtcctcatctgaatgaggactttcatttttctcttagcataattatatttacaattttaaagagtagatgtatcactctggtaatattgtttaaaaatgattacaaattaaagaaaattaactcacctgtgaagattaaaaaataagtttgaaaagacattttgtgagagaaattaatacatctaaagaaagagctaaattaacatttctgacttgtgtgtgaataatgaaacttataagcaaaattaaaattcaaaggtaagcatacttgatgggaaatattagcttcacatcctttaattttttaacacaaactttcacctcaaactttgtcaaatattccccaggcagggttggaaatgttaagtcagccaactctttcagtttatggttccaccatcaagaacaccatgactcttatactacttaagcaaccattgccagaaaatttctctcacttttataccttaaaacattttcctttgcattaaacctagtgaaaaatagaaaaagaacaaacgatttttgttttagacagtataacaaagtgagtgtatacagaaactccacctggtacagaacagattgtgtgtggggtaggggtgcatatatatgtatatcatgtctaagctgatgtaaaacaaaaaaagaaaaaataattaaaaataggaaaaaaagagaatatgatttcacaatggtaaacttaggggctggcatttatcctgaggaaatatgctaagctctaggggcttagaatatttttgaaaggagtatttatccttagtgaaaaagctggagttgggggaagcacagggctttcaagcaggtggaaagttggatcaaagaaccctcaatatctcaaagtacaggacaaaagtcacaactccagcacataaaccggattaaaacccatcccacaaaagcacaccatctatctaggcctggctttggaaagaaagactcaatcccgaaaggtaaaaaaatgaaaataaataaacaaacaaacaaataaaccccactaaagtacaataagttttaagagctctcataatagaaataacaaaacagtcatcacgaatgaatctaaatatgcatgtaaagttaaggaggataaactaaatattcagataatagatttaaaactaaggaatgataaaaatgctatatatgaaacttctataatgtattaaagtggtatgtagagaaagacaatctttaaggctcacattagaaaaaatatgagaaattaataaactaagcatctgatttgagatgttagaaaaggaacagaagagtaagttcaaagaaagttaaaaaaatatgattaggagtaggtattaaaattaccatatgaaataagccatgaacactgttatgccttcaaatttgaaacttaggtaaagacatattttggaaaataatatacatcattaaacatgactaaagtagaaataacacgatttaaataacaatttgaaaactgaattattaaaaaattttcaaaaatatcaaatgaaaaatgggacattatcaaggaagaaaggcatttaatttaaaaataccttttttaagagaatagaacaagaagggtagtctattttatgtggttcttatagtcttgattccaaaaccagaagaggtcattttgataaaagaaatctcaaatttttgcaaatatactaaaaataatagcacaccaaaatggttaataaaagaagcataagacatcaagaccaagttggatttattccaggaatgtaaaatacaagtttgtctcaacactagaaatttccttatttaattagtttaagacattttagattaaaactaaatgatattgggatatagacaaatagatcacaatatcattatatatatatatatatctatagatagatccagatatatctagatatatctagagagagagagtcatcttgataaatacagaaagggtattcaatacaaacagctgatggatggtgaaagctcttagaaaactaagaatagaatcagggaaatgcaacttactgcctttaataaaaattattggcaaaagcaacagggataatattgatgggataatatttaaagcattgtctttaaaatgagaaacaagaaagaatacctgctgtcaccttctctactcaacattatacctgagatcctagcctgtgcaacagacattaaaataaataataatactggtcataaagaaacaaaactctaattagccacagatctgattatatataatgggagcccaaaagaatataaaaacacattattagaattaataagggaatttagtaatgttgctggatttaaaaccaattaacaaaaatcaactgcatttctacatacaagcaacaaatatttagaagtgaaagttaaaataagatactatttaaaataagaacttcagtattaaatattttggaatatatctaacaaaatgtgcaaactgtatttagaaaattgtaaaattttattcaaaaatgataataagtaatacctaaatcaatagaacacataccatgttcataactaagaaaattcaatattgtaaagacatcaatttttccctaatgtatcaataaattcattacaattttaatcaaagttccaaatgggtaggatgggtgtatgtgtgtgtgtgtgtgtgtgtgtgtgtgtgtgtgtatgtgtgatgtctgtgtgaactgatgaagaactacttctttatatggtgatgaaaatagctaacatagttctaaatgagaggaattgagcaggaaaatttgccttcttagctttaaatgcttaatataaggctacagtaattaagttagtttggtgttagcacacttacaaagatcagtggaagaaaagataaagtcataaaattaagatatgcatttaagaaatgtttacacagtatatgaaaatcaattttgatggaaaatgacataacccatcatgaaaggtatattttaaattaaaaattcttcaaaatctttatgattcagggtagaaaatacatttttaaaagcacatattaataatggaaaatattaataaactgactactatcaaattaaaaacttcagtatatcaaaagacaaaattaaataagtacaaagaaaaaagtacaaatgcaagctgcaaactagttgaagatatttccaaactgtataaatgtgtcttataagtgactcctatgaatcagtagaagaaaaaaatggcaaaagacatttaagaaatttaaatgactcacaacctgaaaacatgctttaccttctttgtaatcagggaaatgcaaattcaaaccaaaacctgatactatttcaagtcagagtggcaaaaatgaaaagaagacagtattatgtgtttgagaggacatgaggcaacagtaactctctctcctctgctgatgggagaatactgtatcgatttcttggaaagcaatttggcatcattttgtaaagctgaaactgcccatatcttgtaacttgcaattctactcttaggtatactccctagagaaaaatcttagaaatgtacacaagaagacatgtaaaataaagtttgcacaacaacgacagcaaaatctggggtaatataaatgcccatcaacaataagatagataatttaacaattacagctctgttgtaaaataaaatatttcaataaaaacaaacagcaactctccaactgttgcattttttccctttgtcatgctggattatggggaatattaatgctcaaaatactgtcgatatggttgctgtctcacaatagtaggataaattgaacaatgtgtataagtctctgggcatatcttaatattctctattagattctatagtaattttgaccataaaaccttaaaaagaatccaactataatagctacaacatcatttctaccttgactggtgtgaatgtattatataaaccatgatggagtctctgtgccatactatatattcacgccaagaaatgcacaggtaaatgaggcagcccttgccctccaagatttttcagtttaaaggtgaagacagacttgtaaacaaaatttaaggaagttatcacagtgttataacatgcaggagaagcaaagaggaagaaccaactaaccctgcctgaggggatgagtgaaatttcacaggaggtgtgaccaacctgatgaaatggcatggctcttttgaggaatgttgagtaattgtgtgaagctgatataaaagaccttggcattagatgtcagcaaaaattgatgccaggataaattgaggtcagatcaagaagcgtcttgtgtatgatgctaataggtcatgattgcatcccgcagaagatagtaactcatgaacacagtttaaataaggaactgagaggataaggtttgtgttatagaagagcttagcagtaatatagagggtatacttaaaagaggtgtgatttttatatataaatgtcctttccagaatttaatccctctttaacttgaacccttttttctgtggattatatattctagcagaaaatagccatgagaatgtaagaaacattcaacaaaggacattgaagtaaatacctccctatagaactatctgtgaaaatataaagtcatatgtctgcataacaataaatacaactgtggatacagaaagaatagagtctaaaatcgaaaaataaaacttcatgctgaaattaatactgttgtctgaaatgaagactgaaagtatttcagttttatatatttcaagaatatacatttatatattgcgatatgtgtgtacatttatatctttataaaatatagaatatcatatataatctctatatattttaaatacattgaaatataaagtatatatgtatatatgattaatatatatattcaaatgccagacatcttatggtgaaatatttttcttaattattagatttaatgatataatttttattacttaagatattaatctgtacttttgtatcccataattagcttaacagcttagtggagaacgaagaaaatactagatggataaagaaaacttaaaatattctttaaattgcacacttactatgttttgtaatagtcaaattacttctgcataaataaaaggcatgtccataaaacaattactatgaaatttagaatagttggaaaattccttaagactctttttatctagaacaatctaaaagagaagtatgtctgttcaaaaactctggctttattttggatttgtttaataataataaaaaacaacttgtaaaagacaattaagaaattcaatgaatattttgaattgtgacctatgtttgtccactgaaatttaagtcctactattaaattcttttctttttttttttttgacagagactcactctgtcaccaaggctgcagagcactggcatgatcttgggtcactgcagcctcaacctcccgggttcaagacatcctcctgactcagccccccaagtagctgggacaacagggacgcatcaccacacctgcctaactttttgtattttttgtagagatgagatttttcttttttttttatctttttcttttttttttttttttttttgagacggagtctagctctgttgtccaggctggagtgcagtgacacaatcttggctcattgcaatctccacctcccgggttcaagcaattcttctgcctcatcctcctgagtagctgggattacaggcgcccaccaccatgtttggctaatgtttgtattttttgtggagacagagatttgctatgttgctcaggctggtcttgaactcctgagctcaagtgacttgctcgcttcagtctcccaaagttctgggattacatgcatgagccacggtgcctggcccctaccattacattcttaataacataataaatatttattagttttatcacaacctgacatttaaataagagccatgaagtcttataatgcatatattgtaccactacagtagcatgctatagagaagatattcaaatatgattctttcttttaaaaattcagttaactgttttgtaggctaggaagactatctttgctaaaattattctattttagcataaaacatgcaacaacttggacagtcaattttaagaaaattatcatggaaaaagtaactacattggagacaaatcttaatatagagcagagaattttaacctttgggagaagttacacctctttgggaagctgaaaaaaaaatatagatctgaagtgcatcttataaatatgtatgttgcccaaaaacacaaatatttacaaacaagttttcagagtttatgaaatatttgaatcctattccaagtttaaaacctttgacatacagagtaacaaacccatcacactcacaagggtgataactgatctcccagtagtcaatatgttatttctgcagtcttgatttaattttctggagtttctatgttatttctggagtcttgatttaattttctcaattctacttacccaagaagtgtttctattttcaagtactagatcaagtcctaattcctccagaaaatcatctttgattttaagtgtcttccaaactttaatggcaattattatctgtatcattcatttatctttcaacctataaaaattattctaagtttccgacttcataggcactaagtctcttggaggcaaggtttgtgtattacaacaatttccatttccagtgcctagcataaaggaaagcacatttataatgacagccaacacatactgattaatattgaaatcattttattattttaaaaggtaactacatacttttttatgcaatcccaaatattatgaagtgataccattaaatattggtttcctgaggcccaagtgttcgtaatttggattccattgacttgtatcagatcatgttattttgtttccttatacttcttttggtttgtatgcatttactcaaccttcctgctacactgatgaaccctgaaagtgaagagtacatgtctcaaagccaaaggataccagctgatgtcactgaaaagtatagtagccattcttctttattatagatcactttgccccattctgttttcaaaaagctaaatggaaatgacctcacaaggagaggtacttagctctcccaattattgtattccagagaaacaaagtgtgtgttccagagaaacaaagggaaactaaatatcggaagatgcatatttatattttaagctatcctcaactggcagctatccctatgatgattttcaaatagttaattatttacaatacaaacgttggaggaaggaattcttttttttattattatactttaagttttagggtacatgtgcacattgtgcaggttagttacatatgtatacatgtgccatgctggtgcactgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggtattttgttcttgtgatagtttactgagaatgatgttttccaatttcatccatgtccctacaaaggacatgaactcatcattttttatggctgcatagtattccatggtgtatatgtgccacatcagagaaatgcaaatcaaaaccacaatgagataccatctcacaccacttagaatggcaatcattaaaaagtctggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggaaggaattctttaatgtaattttatttttattaaaaattcttcagtaaaattagaaaaaaaaacttgccatatcaatagtcatcaccaaattagtatgttttatactctgtggtagaaatagtctcaattatgattcagggtattgcagataatccgcagtcttatgagcactccaaattcaagtgtagggagaaatggttactgtaataaaataagtccagtaatcatttttaaaacatagctatttagccttaggtttattcttgttatgtatagcaggtccggaaaaatgatgtaccaatggctccccaaatactgtttttcctgtatggctaaggcagttagtaacaatggacatctgttgttcatgtgatactcatccatgacaatcaagaatcctttagtaacccagactgctattttccaaaagttcctccctcaatatcttatcttgcggatcagaagtctatattttcatttgtatcctggaagatgatgaattcccccatttattaattcctgttatacataactatttatccgtctgtctcctaatttcctaggaaaacataaatccgtcatattaatgaaatcagtgataaacttcagttaaaaagtagaaatacacttgtaatatccatgtctgaatacaaactagagttctctgtattttgtaatgctggtggcaggtcatgatattcattcacaaaagctgccaaaggagacacaaaaagaaagcgaaaacttgaaataggtcacttcttcacgttgacaatggttgtggtttaaagttacctcaggcttttttgctattgataaatctttcaaatatattcatctctcacttatttagggactgattatccaatttgtgaactatccctgtggcttctcctcttttctctaatgatttctcctctgcctatttccttaaatcgttttaatactaaatgagctgcatgaaaacagaaaagaagctaaagcagcaaaatttgatacatataaacagtactgcaaaagaatttcatttgtgctcatatgtttttgaattttcaattttctgttaccccacttccatatttcacactccagattatgtcaccccacccaactcccaataatttgaaattcaaatttggaaattcatctattggttcatttagttggaaactgcatattcacaggtggagagtggaatatatttcaaaaccacagagaaaaaaaaaaaaacgtaattcaacttcgttaatttgtttttaattttccaaagctggaaattgtctctatatctcaattgatgagtttctgagctaaaaacaaaacaaaacaaaacaaaacatcatttcctgtaaccagatttcactgctttcattctaagcaagatgatataaataacaatgagtagtcaagtatttattcacataaaacaatcacatttacattaattgtttaacagaaatctttgcaaattaagcactctgacctgataattctaggcatctcaatatagtgaatcatgatcttttgggaatagagagtgagagaaaaagtgacctcagagaagtaaagtataaacattcattttacgcagatggctataggttttgctctggacatttaatatcttattccaaatataaaccaaagccagaaacaatactgggatatgttttatgcctcaattgcagaaaggcttattgaaaacacactgaaacttcatagagatgctagtgtgggtacagaatgtagtgtttaattgcaagactacagaataaaacagttgattgaaagcattctcagtggatcattctagcctcttctcacaattctcgcctgaagccccttgataaaatttgttataagcttaaggaataaagctatattaatgattttctgaatatatctaatttaaaaagtacagctgtttctcaaaatcatgaaactaactttaaagccaaatacacgtggtttgaggttaattactattttcaattatctatgtcttggctcttctctgatcagaagaaagatgaaggaagagtattatggcctgatctcatttccgtcctcaagaaattctgattacaaacgaatcttctatggtgatgacttgcaaaatagcttgaaatgcaacagttattcaactcaaaacaccaaaattatttttccaaaatgacttcagcaaatcatgaactaaaataaaagaacgtctataaagacatttttaaaagcactatgctaaataattttacatacccaggaagtatgcaaatgaaaatgactaaaagaggtatttggtatataacaatgtttttcttgaaaaaaaaaaaaaagatggcattttttttcctccaaaggcttttatggccaagtattggaagactggcagttcatacacattttacatttaacaggaaagaataaactgggaataacttctcagataaatcttcacaatgcaatgccaaactgtgggcataacgtgataatacatggagcacttataatctatgagatcacccaactttcaggaaacgaataatggaaaagtagaaaaacttatcagatgctcaatttgaagtttgagaaaagttaagggtattttaagggctgagagtgcgcctaaaatagtaaaaaattaaaataacaacaatagtcacaaggacaataaacactaatatcatgtactgatttggctcctgtatgttaagaactataattaaatagtttattctatttaatcttctatgagtaagatattattatttttactttacagaaaataagattttctcagcgtttaaagaacactttcaaagtgatatattcagtaatgttggaagttggccacaaaatttaagtcttttgcattgataaaaccataatctttgttttacattacattgaagatccaggaaaagaagaaagagaagttaatgaaaaaatatcctttggctcttccattaaataaaaaacaaacttggttgattgaaatatatgtgtgatacatccaaataggaaaagaaaataggaaaaatagctccatttttccttcgattttttaatcaaaataaagtaactatattaccataaacatacaaccatgcttccaaacacaatcaaaaacctagaaatgttgcttactctacttatcccgcaaatgtgtcctaaatacctcagcatttattgtagtcttaaagatgcctgtgacaaaggcaagtctgtggaaatgttgttatcatttataatggcaaacttttagtaggagctagaggtgggagcagtgatttcaaaaatacttggcaagccctaaatcaaattttgaaaaacagaaaaacatatatatttatacttactaacggctgccatataagttaagagaacacaagctataaagtcagaccaaaccagctttcaattgcttgcacatgttttatagaaatgttagaaatgtgtgaccttggacaagttaataatgtctgtcaacctctgcattagttagggtgatgctaggagttcaacaactaaacactagtatctcaggtttttaaaacacaagttaatcatgttcatttaaagtccaacggatgtacctcatggacaactgtctcttctccaagtagaaattccaggactcaagttccttccatctgtggttccactgtcttccacgagtggtgaccatgggttaagtcagagaatggaaaggagaatggaagagaaagtgtggtgaagttttatgggccaggcatagaaataaagcatgctatttccattcatattccattggcatgaacttggccctgccacttcatttcccactttttaggtagagtgaacaaaatggtatggtgaactctagaggaacctcttaacaatttctgccacagccttaatttccttttgtaaaattgagagaaaatctaatttgtagtgttttgtgaaggttacttgagaaaatgcagatgacaaatttaggagaaatgttttcatattgtaaatatttactaaggagtaaccattattagttgttttactagttctcatcaacatcttcctagcagcaagcattaccaatttctaggaatataaattaatttaaaaaaagacattccaatgagactatagcttttccctccccaacccaacctgttccagagtctactcattcatttgctacaaagtatattgtagacttactatctgtcagaaactgttctctctggtgaaataacaaagcgtaagctctgatgcattttctcaggagctcattatactagaagaggcagaacacagatgggaaattcagatataatagtttaggaatgatgaaaaagataaagtagctaatgcacttagtagatttcttgccatgttataagcaatcaataatactaatagtgacataagtgcaggaagccattgttgcactgaaaatctactaaacaagcttacaaaatgaagtcagggaaggaatcctggaagatacgggtgtgtgttgtggtgaggggtggggatgaatactaaagaaagggacacggaggtattcctcctgctaagaggatgtgataagcagaagcacagaggcattacaaaatggaaatagcttatacctgaactagaagcctatagtgattgtgggaacaaagaggtttagaatgctttgtatgatattttaaggagctagattgatttctgtaaacaatgggaagtcatttgagaggctttaaacagagaagtagcatagcaagatatttgctagagcagtgagaataacggatttgaaaaacataaggctaacataaacaaagagcagttagagaacacgtgtaattcacccaatgtaaggaaggcaatgaagttatgagctagagcaagatggtctgtagtattctttctaaacattaatgactcaagtctaatcatgagaaaacattttgaaagaacaaattccatattatatttaggaagtaaaataatcaggacttaataattgattgtataggtgagctgatagagagtctaacttaaatggctagatgaatggtgctgcagttgagactgatcaaaaaataaaataaaaaaaaaggagagacagcaatctagacgggatataaagagttcactttttaacatattgggtttgaagcaccatgcagacttacaggtaggagcattcggtggggagttaaacatgaaagtctgaaacagcaatctagggtgaaattatcattttgagagtaattactattttagtagtagtgaaatcttattccttcctggtatttgctttgaaaatggttttagcacttaactggtagaaaaattgatttttttcttaagtgaggaatctataatcagtcacatcaaactcctaaagtagtagaagtaatgagaagaagtagaaaccaagcctcctaagaaatattttcatacacaggcactaatctcgtttaaaattgcttccattgtcttggaagggcctagaagcagtgccacttctataccctggtagcaatgagcgtatctggcacccacatcacaattctaaatactgttcttcaacaaaaataactatggatccctagaaaaattgcagattcaaactggggaagagagaatacacggtgaatcgaacattgtgtagtgccagaaaataaggaagtgctaaaaaatatacggtatcctaacaaaagaattagctaaagctagatcaatttgagaaacaaaataaatgacaatagtatcgaataggaactgaataaatatgaatctacgctgatgtaaatgaatgaatgaatgaattagctggggaagatttcatttatagaagaatttcaaataataaatgcagaataaatgagggagatagaagaaatgagggagatagaaaaaaaatcaccactagaataccccagtaatatttgctacagccaagctccattgaagaatgttaaaattagtggactaaactttaaggacaaacaggatatttgcataacctaaatataacttccccaaaatacttattaattaatgtggtgatttgaactcaggcccacaaattctttgatattcctctctcgggtggtagagattaatttctctctccttgagtataaactgtacttagtgactttcttctaatgaacagagtatgggaaaggaaaaatagtatctttacagtggagaaatctggtaaacatcaccttaatcaagtgatgaaggttaatatcaccagtgataagttatgttgatgttatgtaaccctagttagatacaatgagaagagcacttcatctaagcagcatttttcctaagtgaataatgcagtctaaccataagaaaacattgtaaaagaacaaattctacaaaatacttgcccagtactcttcaaggcgtcaaggtggcaaaaaacaaggaaagactaagaaacatcatatattcctaaagaagcatgacaactaatagtgatgtggtatgcatatttaatcctacaataggaaaaggacattagtggaaaaactggtgaaatataaactctgtagtgtagctagtgttgtactaatgtacaatgtacaatatacccaatctaatttcttagatttgagaaatatactatatttatgtaagatgttaacattttcagaagctgagtgaaagttatgtaagtaccctatataatattttactattctataaatctaaaattattttcaaattaatttttttaaattttctgactagtatcagaagacaaatacggagagcattatggaactaaactatgtgaggaaactttaaaatacatatatatatataatgattattattatcaaagccagttctgttatataaattcatttacagtcgaaagggagggaggataggaacataaatacaaaaaatgaccaagcaaatctcagcaaaattccaatagcctccccctccacttcatgtttgagcaagtgagagaaaatcattagttcattcaaacttcatccccataatattgctcctttacaagtatccttgcagtccctgtatctgacaagtctacagtaccctatctaacaaaccaaatgaaggtactttaaggatctattcattcattcaatctattatttattgagcatctcttatgtgccaggcatccttccagatggttgggatacatcaatcctagttaaaactggattagacaatacacagtacataatccaatcctctgattattcagataaggaaactgagatcacagatgtaaaccaaagtcacagagaaacttaatgtcagaaccagattagaaaccagtctctttttcaccagccttctcaactcaaacaatgattctgggttgaggacagacattgagagaggtgtaaatgtgtttgttttctctataactaggaaatacttcttcaatctaaaagggtgatttcagttcaagataatgatgcattcaaagagttcttgcttctagcaatctttattccagaaactggaaactcacacttccaatttctgaaaattcttgttaggtaattctcataattgttccacctttcttttttttttcctccagaagtgaaaagtcaggcttggaaggttaaatgcttttttgagctcatttaatgagatagtgacaaagctgaaaatagaagtctcctgattcctcatgtttgccttatttcacctcatgttatcacactgaattaaattatatttttctgtagtactctatcaggaaaaggtgtcctgaataattgtaaagcatgggggataaaaaatctaatggagctttattatttatttatgaacccaaaaacatgaggatattcagtttacgttcagaggacaattagtaaaacgtaatttgtagaactaggtctatatgactacagtaagtgggaattaaatatttgataaataaagcattctggaaacattttgaataccacataaatacaaacctttcacccaaaaaacataacgaatctagtagtttgaatctttgattttgccaacaagaatcaaaatacattatttggcaatataagtggattttttaataaatagtttaacctaatataagcatttgagtattaacatttgaataacctaagcagaaaaaaaattgttttacttatcatttagtgaaatccactaattaggaacaactgtagacgaccaatagtgtatcttaagattaattctttttcttgggaggctgaggcaggcagatcacgaggtcaggagatcgagaccatcctggctaacacggtgaaaccccgtctctactaaaaaatacaaaaaaattagccagacgtggtggcgggcgcctgtagtctcagctacgcaggaggctgaggcaggagaatggcgtgaacccaggaggccgagatcgcgccactgcactccagcctgggcgacagagggagacttcgtcttaaaaaaaaaaagggacccaattttaaatggatctaaactttctaaaaagaaaagaaagtaaataattaagcaacaaatacaagccatgtgaaaggaattgttttaaaaaagatttttctgagtgctatgggtcagtttgtggatgggatgaatgctttaaaaactgttgctcaccataatgaaagatacaaggtactaatcatcttttataatttcaaaattcaccattaaagtctagctgtgcccatatttagacactcacattttcctaattttaaaaaatgcacctgtagcagaattttttctccaaaaagacagagccagctggagagagagagacaattaaagctgattggatgactcagcaataaaaataggaagctagctggatgagaaaggatgagctgcaaggaaacagattgccagggaggggtttctttgaaaaaaagaaaaagagataaaaaggaacccatcaacatgaaagaaaaagagataaaaagaagcccatcaacatgaacaccaggactgaagttagacttttcagctaatggagaatccatttctgaaattaaaagagtaaaccgtttattcatggtcaaattgtatataaggttatacaattaatacctattatgctttcgtaagtagtcgatagaacaataatgataccgaagcaggagtctggtatttatcaaaggacaactaggcctttcttccattaagtgatggcactccactccttcctgcagcaggaactagtgtcttgtccttttgccgggaacatatctccttcctctttctcttctcaactccccactcatcactcaaaactccaccagcttcatgattacacctagccaaagattaattttattcttcagactgtgtcagtctcctttcataatacaccacttttcaaatactgtctcctccttcatagcccaagaatatatgtgtttaattttaatgtttttaatatcatgtcttatgttaaattgtaggatccataagaggagaactgtgtctttctccttgacactgaacaagcaggcactcagtaaatattcattgctgaatgaatgattcctggagagagactaatgagtcagagatgcaatcctgcctgccactaatcagttccattatttttagacaagttcactttgtctcttcatgtcttagcttcccctcacatcacttccatctctgagactttcataaataggttatctaataccctttgtttgatttagacatgagattctcaagaaactttaatctcaagtactacaataatagtatcctcaattcttttcccatcttctattatttctgcagctgggtaaaaaggcagttcttctttcaggtagagaaacatctcctcgtgtttgaagtaaagaatcctaactattataattcaaaagtgtgatgagatcatttaactattcattcaacaaataatgactataaatttactaactcctttacgttgttttaggcaaagaggacaacacaataatgaaacaaaatctcatgttcctagagctctcattctggaagagagagagagaaacaaatgtatactacatgaagtgataaatgctatgaacaaaaaatagaacacagcaggatggatgagtaatgatgaagagaggattattgctttatataaagtagtcaaggaagatctcaatgataatttgacatttgacagagatttgaaagaagtgaaagatgagaagatacctggtgaaagcatattcctggcagagttaagaactcatataaaaaccatgagtcaagggcactcttggcaagttccacgtagtgcagggagatagtgtggctagaggaaataaacaaggactctgtaatacaaggtgaggtcatagaggtagccaagtcagataatgcaggaccttatgggcctcttgattagattagaggccattggaacatttgaaactgtgagatgctatgatttggcttaggctctcaaagaaatgttctggctgctgtatgaaacataagcctaagtatggcaagtgtagaagtaataaaacacttaggagggttacaataacccacgcaagagattatggtggctccatacaatagtaagggtatatagctggttagaagtggtcagactccagatttattttgaaaatagagccaatgcattagagatggaaacagtgagaaagagtagttaagtaatcagtggaatagaatggactacaattgacagtgaggatctaggaatgcacctatttcacttgcataccctgagaatgagcagaggaaaagagaaagtcaccacttgcaagggctacaggtgaagcattgcccctcaagtgtcactgggttttggtttaacaggaaaaaaaagtgagtgggatatttaaagaagaattggaagacagagggattctattgatagagacctcaaaacccacaggacctagtggaaagtgtgaaggatggggctggagaggggcattagatggggtcagaatcatggatgtatggagccatttgggaatgagaaacatctagtagcctgggccctcttgtgtttatggaggcaagcagggatgtagggcacactggaacaagtctagatggtaccttaggtcaactgtggtaagtaatgaggctgggaataactctaggggaaggcaaggcctcttcttgccatgaatctgtggctttctgagataatgagaaggcatatgcaccctcttctgtcctcaggctcctgttcaaaatatttctcttagttttcctcataaaattgtttgatctaatagtgtgtagctgttaaagcaaggctacatgttggtattaaaaaaattcatctggctgggcgtagtggctcatgcctgtaaccccagctctttgggagccaacatagtgaaaccccatctctactaaaaatacaaaaattagccgggtatggtggcaggcacctgtagtctcagctacttgggagactgaggtgggataatctcttgaaccttggaggcaggggttgcaatgagctgagaccatgccattgcactccagcctgggtgacagagcaagactctgtctcaaaacaaaacaaaacaaaacaaaacaaaaaaaactattaatcttcatgtacaatatgtacaattagtgtcagtctgccatttcctagagtatttgcaaagataaggtagggcaccccagtccccaggcttgcctcattgtccatatcttcctgatacctcataccaataccaactgtgcctagtaccttcacatattatagatgctattgttcttgattaggtaagagatgggaaaaaaaacatgaagagctctaatttatattttaacctataaaattatagaataaaaagcactctcacctgggaaagagaaaactttaaaaaaaagaaagaaaaccctacagcttttttttcaaagtctaaaagggatatgaaaaacatagaacagtaatgtgttaataaaatagatcaattcagtgcgaataaaataaaatttcaaaattgtaatgagctaagctttggcatagggtacttagtaaaatgtattattttattgcaaacaccaaaaccaaaaccaaaaaaaaaaaattcattgtcttattaggacactattttgatcattctctaatattaaatctttgaccttgtttacatagaaggcacatttacaacaacatgaagaaaatttgggatgatacaggcaaaacttttgtgctcacaattcacaacaattcttttatgtgccaggaattgtgttcaggtcttgccttggactctttacagagatactagctccttcagtctttacaacgttcctatgagttatctattcttaaccctactgtatagataggaaaatatacacttctcatgatgacaaagctcattagaagcagaaagaaaatttcaacccaaatcatgtgtatgtcaatcacaccactttgctgtcacttatcaattttataattgtgaaagactattaatttcaattacaaataaacatctaataatgcttctttgttgaaaataattatataactatttagaccacctcttctgaatattgacgtggaaatcactgaaatactacgctcagcaatgtgctgctcctgggaaacatccttcaacaatcactcctgagtgctcaccatgtggcaggtaatatctaagcactgagaattgtgtactaatcaattatgaaccagccagcatcctactagagacagagtagcaaagcagtaaacatataaataaaaccattctaaatgccaacaaacaaagactcatgatgtgaaggtaaatgtaaaggagtagcaactttagctaaaggtgttcaggaaatatctatttgtgaaggttaagatctgagctaagattggggaggcagagaaaacaaccaatgtaaaaattcctaaggaaggaccaagcgtcaaaaaacagaaataagtctaataaagctagtgaatagtctgcaaaaggggaaaacaatacaagctgagtttgaaagggtcagcagggaatcattcagggccctggtcaagttaattctaagttatcagaaggtttcatttggaggacgcagagagttataagatccaattaaaaataaaaataaaaaaacctcacagagaaggtaatagtttcatatacttatatatgtatgtgacatacatatgtatatgattaccatatatatacacgccatatatatatatacacacatgccatatatatatgtatatataacatgtatatatatatatgtatgtgtgtgtacatatatatataactgggtccattcattttcctgcacttctgttccaaatatatttctcaaagtcaaactcttaagggctgatgccaaataagatgactatgccttcaggcaggaagaaatacaattccgtaattctggtaattctgattcatcttgttctttctgtctagatgacagttttctttttggtaactgacattgaaatatagaacctgcaaaatcagccatttatcacaccaagtcactagaaggcttcacatctgaatagcaggaatgttgcctcttactaagtcacacatgtcattttttctccaaaataatctggatatgattgcatgtgatcagtttgcatcatgtgagaaagatgtatagtgttctccctcatcctcattatgatttgcattatactgagccatcactccaaatgctccattatggacgaggtgcaaccatggtgattttatttttcactgatctggggaagcaaaagagactgtcatcaacagttgattatggcatcctacatttctgctgtaacacaaccctgaaataacagtagatggcaaatttttaagtcactttttgtcaaaataatacctatcatgtctactttgcaccacatatatgctgttagaagaaaataatttccttctttataaaataaaatctaaaatccccatttcagggtagagtcaagataagagtctatcatatatagttttatctgtgaatactatgtttaacttcagggaaaatagacatgaatggaaataaacatatatttactttacttaagtggcagggcattatccatgagcttgtgtacaagaaaaatgtcataacataatcataaatgtggcatttattggaaaaatgatcacctccataagccatttacaaccaaagtgtcaacaatactcttagtttctttgtgaaattttagataactttatttaaatatatcaaattttattcgtgaattctacaaaagcatagacgcaaataaataataatggatttccacaccagagtagagaactcaaaaactagcagctttttgaacacttctgtctacagagagcactggaacattggtggcataagcaaacaataaattgccaagcaacttgtattttcatacattgttctttacttctcttggtgtgataaaaattggtcctctcaaggtagagagtgactggagtaaaaaagtgaacacattagtgtctccctaacatcactatttcacatggctcacatgttcccacaccatcaaaagcctaaacctgaataatgcaggccctggccctgcttactgagaatactcattactattattgttttattatctaggttgtaaactctttcataaagctctcaaaaaatcacctacttaaaaaaatcacaaaggaaaagatagaacaaaaactgctaaaaagttggaaaaaacttttctgaatctttgtaaaaactttggtgaatagaagcatattaataagtatacaattcaggataaaatgcttattagtagagaacaaaaacattaaaatataaatgattttagtattacaattaaaaggaatagattttcaggtttgataaataaaaagactcaactatatattatctacaaaaagctcacttgaaacacacacattgaaaataaaatataaggctgggtgcagtggctcacgcgtgtgattctagcaccttaggaagccaaggcggtgggtcacctgtcaggagttcgagaccagcctggccaacatggtgaaaccctgtctcttctaaaactacaaaaaattagtcgggcatgctggtgggtgcctgtaatcccagctatgaggctgaggcaggggaatcacttcaactcaggaggaggaggtcacagtgagctaggtgagatcatgtcattgtactccagcctgggcaacaagagtgaaacttcaactcaaaataaaaaataaaaaaaaaaaagaaaataaaagaaattattaaaaaacatatattatacaattattaaagtacagtggcaatattaatatccaacaaagtagacatcagaggtaaagagagtcattttatagggataaaggcagcaattcaccaagaggacataacaatcctaactatgtatgaaattaacagcatagcttcaaagtatctacaataaaaactgatagaactgaaaggggaaatggagaaaggcaaaatcattgtttagtatattaatatccttttctcaagaactgtgagaccaagcagtcataaaatcagtaaggatatggaagatttgaacaacattgttaattgagtaaatttgacctaattgactattacagaacattctaataaataatagtagaaaaacatattttcttgagtgaatatagaacattcactgagacagaccatattcttggcaatgaagtgattctccataaatcagagtaaggtgtaaaactcaaagataattaaatatatgatagtaatataatttactggtagccaaagaatcctaaagtagttaatttgtaagtactttctaagtctgaattctttaaaaaacaaagtccaaacaaaagtaacacattataagcaaaatgtacatattgtgagtaacacttaagatctgggttttattgcttgtatttcaagtgttctcaaaatttcaagtcagtaagttttccttataaaaaaattactcttattatatcatacatttataagacatgctccctattggtttagacaaaaaactaaatcttaagaattgtaattatcttaagtgtgaaagttaggaaattaaattatgctaatattcatccacaattaataaattattaaactcacactaaatctaatgttttgaaacctgaaaattggtacttccattaatggagtaatgtaaattcctattaaggttgagttcacttacaaaaagtaagtaaaataaagattaatttatagttgatataccccagaggctgctctgagggagtcccccagggtaagtgccagttcctgctaatacctaaaagagtgtctatcagctttctaagcaccttgtgagcttgggagggagatcatatggtagcaccatcatcggccccctaatgcttccactcttgttcaaattatagcacacgccaatcaatagggaccctgcctcaaatcttacctgcctcttttccaaaactagtatataccagtttcagtcatatttaagcagagagggagcaaggtctattcaagattttgaacaacagagtatggatttatatcctggcactataatttactagctgtgcaatatggggaaattgttaatctctctgtgcctcaatttcttcacttttttatggtgacaatgatactacctacttcatagagtcactatggggcctaatcaaattaatatttttaagagcttagaatagcatgtggctccacagtaaacaatgtgtttgctaaaaatatcatggtgttgcctaaaacctttcaaagatttcttattgtcctcagggacaaagtctatactctttaatttgactttcaaaacaccaacttatctttcaaacctcatctctgtatacctaagctatgaggacttaagtttcttgaaaaatcccttacatgtctttttacttaaggaatttaccttggctagaatgtatttctttggctttcttgataagtcctagtcttcttataagtcttatttcaggtatcactttctccctggagccttccttagcctctaaagctgtgatacatcctcaaagagaactgttttttttaaattttttatttatttgtcttttactcatatgactagactttaggctatttaagaaattaatttttgtgtattgttgtaatgtatatgcatagcatatgagtccaatatatatttattaaaaaaatgaataatcaattaatgggtcatacaggagctatattataaaaacgtagatcacatttcctccactatgacctcattagctagctagatggttgtctgggaccaaaaacatccatgagagaaaaacaaagagatcaacctggttggtgattttattttgaacagttacaaaggtaatataagttagtcacaggcctacttggtgatccgttcaagacataccctgtctccatctctcagcaagtccaactactgaagtaatgctattaagcaaattgcttcagttctctgactcccagttacttggtaggactgttcttcttgactttcttgcagttggttgaggccatgtgacattttggccaaaaagttataagaagtgaaatatatcacttctgagtctgattgtttaaaaccctacagagctatctatctccctgtcaaaatgactggcagtggtcatgatggagctgcttagtcagtctacatccaggtatgagatgacaagaagcaggaccgctagcccacctatgatggttatgtagtgggagtgacatattatcatttgctgtgagaagctactaagatatttttgcctgcatgataacattcccaatattgaaaaaaaaattgtcttcaggaaactattgacaactcacagactacatactggagcatgtggatcaagatttctaaaaactctgggaaaacactccaaggaaactctctcccaaattctatgaaatctttgtattattttgtaggctcaagtctgtaacaataacattctttgcatgacagagctatgaggaaactattttgattgtttctttggaaaaaaatgaactttaaaaaatcatataatttaggagaatatgtttctagaataactattgtaaaattttaacaaatttaagttgtagttcttaagctgaagcatttgcttttcatgtcaaataataactgaacaaaataaattatcatccagagatttatactgggtagaaaggaaaataattaatctgatacgtttggtcttgcaagttgagtaagatactttgccaatttggaaatgttctatcttgaatttagtcatctccttaattgcttttattttttatacaaatgttgtgggtttttgcagttttgagaggcagaaaatgaatgatatagcaattaataaaaacataaaattaatggttcttcaactaaggggtcgatcatactggtttcctcaacctcaatactccattcttcagttcaaggtacaatggaatttatagcagcctgagtctctgaaataggacttccttgatccaatgctaatgttccattgtgtgtgtgtgtgtgtgtgtgtgtctgtttcctgataaggcaattatatttattttctcccagttataagaaaaatgactaatagatattttgctgacaaactgttagcaaatcttctggtgagaaatgtgacaaaagaggaggatgaggaaaaaattctgcttccataaaggtaaaagtggttttaaaaattcatagtattagcaagaattgtttttcttggaacacagagacaggaattgatttcctaagagtacgaattacagctgggatcctttgacctctcacttattagaaaataggtattattatctaacccgaaattctggttaatttcactgcctgctatttctcccccaaacaagagtaacaacagcaatgacaataaaaacaccatcaataaacagtcctacaactgaagagatattttacaacagcttttggtggaaagaatgcattggtttttcaaacagaatctatcaatacatggattctctgacaatagccacaacagacacaggtgttggaagtgactccatgctgaaatagaagctggggggtacaagtaaatgaataatatactcatggaaaatgtgaagacaagtgaagcattttgaataaggtaagtgttttcagaactacaggataactgatttgctgttggtcatgcaagtgcctgaatgcagcagtttcttgataatctgttagatatttctaattgtttatttagtaattgtgaaaatttcctggttaagagtctcctacaagggcatccatactacaagaaaaagagagagagaggaactaggttcactttttgttaagttctctgactaaatgcagagtttttaagactgcctataaaattaaaatatattgttatttctccctaaaaacaacaaaaaaaccatttaaggatctttcaaaaatgtgtatgatttgaatgcaaatgaatgtctcatattatattctagcataaggaagttattttgcaatctcaaaagcatattaatattattttaaatattttttttaactcaggaaatctcaccttttagtaaagcatggtatgtaacagcccctttttatttcaattgactaatcaaaggattgtaatcatctggccaaaacatcactattccccactcctgctctcttagaagcctttctaaatagatagtggaggtctttccagtggagccaaaatgtggctttagagccattctcgaaatattctattcaataattcacaatacatgagaattcatacatatttgttatgatcatttatttccttttctaattcctccacaaaaatacaaattttcttttagcaggggttactattcatctttatatcagatagcacagctcagcatatgatatacatatggccaattaatatatgattaagttctatatttgatattataaagatatgaaattttcacatgaaagtctctcatttttatttcgtatagctagtatataattacatatgcaatgtttaactggttgtataaaatcacatatctaagaaatgtagtactaaacagagttcttcaaaaattgcagcattttaccacgacatgtgctcactaaaaatttttttcaccttaagtcataagcttacctactttcaagccattgaaaatgtctgaaatatatgaaataatgattcaactaaatgagaagggtgaaggatttagttggttaagttcccaataacacttagaaacaataaaacaatcatctttgacattaggcaaatctgggtaatagggcggcaggaagacttcagcaaaactgtgaatttttaaaaatttttattgcttactggtgccctcctttctcctctgccagtcaatctaaacttatcacattctagatgaaccttctgctcatacaaatgaacattctctccctcagattgtgacactcacattcatacacctatcctttctgtataaagaattactctcagctacctgtcaaccaacagcctgctaacatgttacctagtaatagcttaaagtatatttcatatcttctatgatactcttgaagatgataaagatcttgaaacataaattaatcattcccaatagtgaaattttagttattaatatcacaattcccaagaaatgtttgagagcagaaaactggtcacttagaacttcaagaatccattactcataacctagcagtcaagagagtgaatgcatctactaccttgcaatctatacatcatctaatattattctaaagtcagtgtttatgtgagcctaaaatattacaaatctagaagttcttcaataactctttcccaacacattggtaattactggcactccttggtaatcactgttattacaaagttgtctcgcttctacaacaaatatgtgtcaggagaagaaagaggagtgatctttactagattaaagattatctagagctacatttctctcaatttcagtctagataaaaatgagaaaatatgttttaattgtaccagattgttaaaagctatgaattcgaatgcttgtgattcattgccagttaactgaaaggagttgttctgaacatttatccttctccttagtatcatccaaaatgaatattttcacacaatgaagaaccacttcccacactaagaaactgtcacactcacaaagctagttgatctcccaagcattactgctaggtactgttaggtagttatagttcctggattctaaatttaaaagcacattttaccacaatccagattctactattttaatctcagctacgatccagaatattgaggaagaaaaaaatttcattctttcatagattctgtgaaagaatcagtgaattaacttgacaagctaattatatcttatataaatatgctctttagactttcaattttagagttcacaaagcactttcatatgaattttccatttatcattcacattttttaaaaatgagaaaaatgtctgaaaatgacttgcacaagatactcctgattctcatttcagaattctgaattcccccattctcaactcacatctccacaaaaacaacaaaaagagcaaaattgaaataattattgtaaaaattcccacctataaacaatctcaatgggaaaccctttctgatcccactactcctgacttagataggattgtatcaaaatagctaccattcctttattttgcagctgcttcaaattatctggagccctgggaccagtctccagaatccttccttactcaacgtctactttcactttaaaatgtaataagaaaaagaatttagctgtcttaaaaaatggtctaaatggcagacttaactcaaaatagccaccagaattatataaccaaccaaatgtatttccttttcacactaagacacgactcatctgatacaaaatctaaattgcacacatcagcaagacagaaaaagaagtcaaagcaggtctttctcagccattacctgttgcaactgaagggctctaattttatttactcttgagctttcataatacagttacagtgcctcataaattgactttctgtgacaattggtgatatacttcaaaaagtatgtttatatttaaatcaatcactcttttgaaataaagcaggcataatcttgttttccaaattttaaattagtaaaaacacctttgacattgaatcagactaaagtgaaagactggtttattagaaaatgatagtaaaaaagcatgtattttccctttttcattagataagtatatttaacattttcatcagagattagtttgagttcacctagttatttgtaacaataaaatattcttggatgtcactgtacccctttccaatgtccatcatgtatcatcacacctttcttatttgtagataggggcactatatacaagaccaactaaagtgactcgttcaactgagataattactaggataattaaagtaacccatgcttattataaaacactctggcaattaaaccagacttcaagtttaaaccagaagcacatcacaaattttgtctccaactttcataaaccaatagtattagcaactttcactctaatagcacacaaatgagtctaaaatagcagtagccataatatatatggtatctgcatgcacagagaaaggaaaaactaagacatctattcggaaactggacaaatgtaaggctaaatgtgctttgtcctaaattagcctgattcatctgctgcttcagttcttcagttggtatattttggggataagtaatgcataataagggtcaggcacactggctcgtgcttgtaattgaagtgttttgggaggctgaggtgggaggatagcttgaggccaggagttccagaccagccaggacaatatagcaagaccctgtctgtacaaaagaaaaattttttaaattagccaggagtggtggcatgcacctgtaatcccaattgtgtgggaagatcccttgagcttaggagttcaaggttgcagtgagctatataatcccaccactgcactttagcctgagcaaaagagcaagaccctatctctaaaaaaagagtaatgcataatagtatttataattctttcaatatctgacagggcaataagcacaataaagggataacaaactcattttgagatttttatattttaaattcatagaaacattcataatataacttaaatttcaataaactttttagtttcaaagtgtatgttcaacaataacatctcatttgaaccttagattctatgagattggacagaaaatcatcaatatccccatactgtcaatgaggaagttgattaatttttccatgatttctaaattcccttggaagatttcccagactttgccacttggaaggtcatatagtttcacacttaggtatgaaagtggccatatttagtgtgctttccctagaacctctcttctactccctaccacacactcatatacaatacctttctcttggctttgttgtttacactataaatgcttgtaatactggattcaagacattgttgttttatttatcggtttgtctatttacatgttttcttttcctgctgaattgaaattccattgagggaataactgaaatcatctagcaagtactttagagcccagttatttccccgacactatgctaggaactgaagatgcaggaaagctatgatatctgcccttttggaatctaatatgtaattgtaaaggcacagatttagagagattacaaattgatgaatgttacaaagcagaagcacaaggagctatactagatccattatagatggaactaattgtgtctgagagattagttaattctacctgaaagaagcaatgcgtaaataaaatgagatggataatctgaaactgttgaaaggaaaaaagttctagaaaacatgaacacatattttcatgaacatgaaacataggatttgaaatgtggtatttggcaaactaaagaggttcaacatagttaaagaatatgagcaaagagtttctcaggttgagggagtttggccagaaacaaatttcaaagggccttgaatattgcattgtatattgacagtaatgaaatgttacagaaatattttcagcaggtgggtaatatggtaatagttactcttcaaaactaccacttttgagttcctgagaaggcaagcaagggtgaattttaaaatagttatgaatggagaatagaaatccaaatgagacacaaattggcttggactaggatggtgataaggggatcaagtgaagaagttacaggattccaaccacaattgggaagtagtagaatcagtaggacttggttatttcttagaaattaaaagagaaggagaagaacactttttagatttctgacttgagcaacaggaaataagggaaaaggagatttaaagaaaaaatgaacctactgagcttgaggaactcatgagatacctttgtagatgtcactgagtcatgtggacattgaggcaactgggtatataatttagaaacttggatatcaatctgattattatcaacatatagccatggaattatagaaaaacctgcaaaacaagaaaacagattgggacaaggattgggctaattaagaaggctgaatgttttaatcttaaaatgggaagcatgaacatttcaaatcagatcttatattctgacatttaactgagatttccatgtcaaaagcactgagatgatacagatctgccacggggcgctgaccaaagagcattcataaaattaagccttacctctaacatatgtatatatacaccacgcacaccctgttaaaactttttagttgtcttggggctgggcgcagaggctcatgcctgtaatcccaccactttgggaggccaaggtgggcagatcacctgaggtcaggagttcaagaccagcctggccaacatggtgaaaccctgtctctactacaaatagaaaaattagccaggcgtgttgggggcacctgtaatcccagctactcaggaggctgagacaggagaatcacttgaactcaggaggcagaggttgcagtgagccgagatggaaccaactaccctccagcctgggcgacatagcagttgccttgacttaacatctcatttccaaatagaactcattacattgtacattaaaacttcagcatatctgttaagctatcacattaaaaagtaaataatataatattgaaaacaattatctcacaatactaataattgtttagagacggaacttaaaactctgtttaattggagaagaaagtatagttagaaatcattttacatatacgaatatccatagtcatctttttctttttttcaagaaatgaactagccaagcaaatagatgattctaggagagtgtaaatgaataacttcaaagaaaacagtccggcattttaaaagatagaaccttaaagtaacataaccaatagaggacacctagtggtctttagcagaatcaatatttgcttgcagaaaatatcaggcaattcacacacatgcaataatgttggtgtcagtagatgtgctaatttcagaaagatgtcatcatatatttataaatattacagaaatatcagtttaaatatttcagataacttccatatgcttcatttcatttgaacttcacaactgtttgattgttcatgggcataaataagtcactttatgtgattttccctagattacatagaaaataatgtcgcagttgaaatatacactaatttctggtatagaatccattccataccatcataaaaattgaaacctccaatataattgatatttaaaattgtaaaacactgcaaatagacttcatagaaggccttatcatatttcattaaccgatacaaacattttttgacagcaagagtacttggcaaagataaacctttttttagctatctaaaaaagtactgtgtttgacaccgactgcatacaaaaaaatgcgaggaagtgataaacctctcttctaactggtggtgttagctctatccacggtggcctccaacccccttcattctgtagcactctaaaatgtaaatcccctgcctaaaatgtatcaatggcaccttttgattaagtccatcattagcacaaattctggtctacatctccaaactcaatctgggaatctgcatctactgcactaggctgcttgtatctcgtgtcttctggaacacactcttctccctggtccacttgttcagcctggtaatccattctccagattcaaaattcagttcagtatgtttcaaggcctcctcttgtgcaaagcaattgtgttgctcactcccttatttgtgccactacttcccacatcatctgtgattatttgctcacatctgcttttcttacaaaactggcatcagtcttctatccttatttgcagcatctccacatacagattactcagtaaatgcttgggagtgaagaacggatactctcttattattatttaacggatttagaacatgggagattgccagtatttagcggataaacatgctctgattatttattgtgtttataaccctgcactaatatacaaaaagattcaagggcaaaatttgacactgattcttccctatgatatctatgtctggcaaaaggaaagcaaaatgtgtgtaataaagcattagtaaccaaattatcatgaacaaatgcatgtagagccagtagaaattttcactggaaaggtattgactgtcacgatagagtgtgtcaatgtagaataccttctggaaatgagttgaagtctgattcttttttttttttttttgacggagtttcactcttgtcgcccaggctggagtgcaatggcatgatctcagctcactgcaacctccacctcccaggttcaagctgttctcctgcctcagcctcctgagaagctgagattacaggcacccgccaccatgcccagctactttttgtatttttagtagagacagggtttcaccatgttggccaggctggtctcgaactcctgacttcaggtgatccactgcacccagccttaactatgatttttaaaggagtgatagaaaaaaaaaaaaaaaagcctttccaaatcggagatgtagcaggaataaaattatagaagcagaaagaatcatttcctgcaagcagcactgtaaaactgaaacacaaacagaaaagagttgggtgcaaatatgaagtgacaatggtgagaccagggaacaatgtgctggagagacttgaaggcacagcaaggaaacacagatttgatgtgataagcaatagggagcctctctaagttctaatacagggcaggtttgggaaaactctgctgtttgcttatggcaagtcttagaatcctatgtgtttttaaaaatataaaagtaattagaatatgtattgtataattatagataggcaatttatagtaacagttagtttctactctacaccaatttgaatgctaaaattaaccaaagatagaaactgtaatctgcattagctccctatggaataaatttccttattactgctctgttgttatacataatttgtatattaaactatctctaagccagtataaaaatctaatattggtttcaagacaagcattgaaatgttcaagacacattattcatctgaaattgctatagatacaaaagatcaaaaccacaggccctctttcctgtcccaaaatgtatttaattaattgtaatatgtcccagttctatacaaaggaggttggggagataggaaatgatgaataaaaagtaaaatattatagttatatattccaaagccatagttattatataatgatgcatttcccactttttaaaattaagaagaatttatgctttatctatgacattaagtcctacaaagagataatcattacagagtagcatttgtatttgcaattaatatttcctaaacctctaaaaaatttcgaaggtcatctcctgttgataaaatgactgagatcagcagctgtaaaggaactcttcacctttacaaactgaataatctcctattcactaagcccttaatctactctttatctcttcagtggcttgtgattgtcacatattccatttaatttccagggatttcctcaccgtatgtctcttttaggaagatcacaaggaatttgttacccttgtgataggttatgaaatagcagtctggcttggatcactgtctttaaacacaataacaacaacgacaatgctgaattcaaataatagttttttaaaaccaaacataaaaattggaaagattcacctcagctttctagctattacaagaaaagaaatttctggcttgatttatctaaattgtctctggtttttacctcacctggcaatatatataaagtttcagtgtaatgtcacagaaagctatttttacatcccaaatctattgatcttataattggttcatgaaaacaacttccctcctcacttcttaacaccatgtgtttcataaattagttgctcaaatcagttttttcctcctgtattaaccactaattcagctttagtaatgataataacataagcacaaaaatttaaagcttctgtatctcattcataatatttttctaatttatctggcatcagggcttcttgttgtttttcagttgaactaattcagtccagaaaaaaaaaaatgtattgttgaagatggaagcagcttcctatagaaggcagcagctttcctcaggaatgattcatttagaacagtggcagcttccagacttcacacattacttccccaaatttgctgaatttagcattagccagcttgatactaaaacacccagaaccaaagacatgtgggtgaactcacatcttcctctgaatttttattgcaaaagctcacagagctactttttctgatttatttgttgtatttttacttgtaaacacatcctggtgacatttagaaaaatcaggtagagagatttccagttttggaaccattcaagtttcttggagattatggttagaaacatgtaggtgatggaaagattaatttgtattaaattctggattatgactctgtttcttccctgttgaacagcattactaatgggcattaaatacccatgatatatgatattatatgggggtatcatataatcaagaaaacattcttcacctaaatgggcttatggttcatttattaccaaggtcatttatttataagaaacatgttgccaacccacaactctagcctgaatgtgcttggttaccaaatgtctgtaagtgcatattaaattgcattttacaataatgatagcagtgagctgatgttcctaaattttatcatggcatctttaaaacacatcatgttacacagatctaggtgcctgtaattactgccagaagccaaaggacattggtggtaaggagtatactcttatatgaccacatggcctgccattttatctgataggatgccatctgttcatcctgctgccattctctagggtaactgggctaaaaccacaagatattaaaaatagtcacattgctactgtatttttaattgactggatgtttatatcagtgactttcctctcacaggatatttgttaaaatatttttccatggccttgttttaagaggtactattcaactctgttgtattgcatggcccacagtcttacttaagaaaagttccctataattcgttagacaatctataaaatggtagaatattaagatatttataactaaaacattatatatcatagtaagaacctatatagttttgcagttaagagcactggctcctgagtctgattgccaagtttggaatcccagctccacttcttactagttctatgaatctggacgagttaccttattgtatttaattgttctcatctgtaaaataatgacaataattatatttacatctttgtgttgttaggaagattcagtgagctaatatatgtaaagaatcaaacatactagctgacgtgtaataagccttcaataaatattagcaattattagcaagaatcatcttggtttggtattaatctcaaattagcataaaaaggctttgagaactgaacatttattccattttagatggaatgtgctatatagagaaaaattacaagatgaatctgatttctcaaatgtgcttcatttgattttaaatatatcccatatctatattttaagaatgatccatttttatgcctttttatcagtgtattatgcagtgttttattattgcatgtcatttcctgaaatcctgtgaaccaaaatgtcactgacaagcacatacaaaaacactgctaccgcctcacagaaatcaaacagaacttccattttatgacatatttaaaaacataatttatcttgaaaatgctaaaaagtatttctgtagggaggaaagcaatattctatagccagtatatgactttatatgactttcattagtgtcgatttaggcattctacaagtcttttggactcttacgcttatgcagactataaaattcaggttataattaatacaaaaagacttaggaagaaaaggaagtcaaaatggttaatattcagactttgaagatagggatatgaactcctttgcttgatgatggtttaactcagatctttggaaactccagttggctgagccctctcaggtcccacccactgcctaacaacagatgctctattcagcaaaatatgggcctgattggtcagattcactccatttattcactatactctttgtgttttctatgtactaatgtccctcatgaatatgttcctttttagtattatgaaatgaactaatagggagaaactaaaataagttactataggcaaggcataacaataagcaaaattaatatgctaaaatcaaagcctttatatatacaatttggaaataaagaaacaatctgttttacccaatcatgaattcaatgaaacttcaatattagaggatacaaaaaccacactatctcacagagctaatgatgtgccagattagcaatcagaccctacacatctttatcaaaataatggtacttgatgtatttatattagattaaaaaaaaccaaggtgggaaaggggttgtattgatcaagataataattgctgattaaagtgcatttatttaaaaataaaataaattggcataaaacgatcactatttttttcagttcattcaaatccattatttgatcatatattttagggatacaaatatatcacttatgcatggaaaagagtcgtcgaatacatttttctacttgaatttcataaaactcattacacattgcacagttgttcattgtaaaacagccataattaacaatttcatgatatagatttaaaaaagaaaaagatgcatcttacctcttcccattgatgtatgtatctaattaaccttgaaagtcgtaataaacgcaagagactgagaatttttgtaaacctcacaatgcgaagtgccctggctgtcttgtaaacttcagaatccattcctttttctacaataagaaagatataatccactgggatggatgagatgaagtcaaccacaaaccagctttttaaataattcatcttgatcactttggggtccaggatgatttcagaactgtcttcattgacagtcccagtcctaaaattcatgatcaggtccaataggaaaactgtatctgatgccacattgaaaataatccatggtgttgttgtttgctctgtaaagaatgtgattccaactggtatgatgactagatttccaaccatcattataagcattattaaatcccagtaaaacctacaacaaataaaaaaatcagattttaagatatagaaaataaccagcctatcccccccatgaaaaattattactgatatatagtgagatcaataagtaaaagaacaaagaaatgattttattttttaaaaatgtaattccttaaatggctatatgtttaaatctaagtaaaattaatatattcttaaaccaaggcattatgattatggaattctaaaaattatgtgatatgaagcattatacaaataaaatcaaaaacattcatacccccatttatttagtaaagaggcaaaaaaagcaacctaccttatacttaatacaaaatatagacagaaactagaaagaagtataagattagaagatctgtaagaaagcctttgggaaggctctttgaagatgttttgaattattttagatgtcaatttaccaatcatagattagaaaaaaaaacccagaaataaataggatactctaacaattttagttatgcaaatttatctcaaggaatacagattagttttgccatggaatctagaatacactggagttttgcagtactccaaatattttatgctttatttttcttttgcttgaaataagaaaactaattttggtctgatgctaaaaagaactgagcaagttctactccatatttgaaactagaatctacctaaaatttgtgtttttattactactctattgaacaactacttcaaatatattgccactacttttccataaaaattctttctttctttcttttttttttttttttttttgagacggagtttcattcttgttgcccaggttggagtacaatggcacaatctcagctcactgaaacctccgcctcccaagttcaagtgattctcctcccgcctcagcctcccgagtagctggcattacaggcgtgccaccatgcccagctaaaaaaaaatctttaacatttctaatttaattctgaacatgcctatgactactaagtaccttttgaaatattcttatctcaacttacattaaaattgagagaaaaccaggaacttcattgctggtttatatagcttaactaaattaactaaattcacttgacataactatagtgttatttttataagggttctttcagtctgttgacactcctattaatcaaatatttatagttgttacagtatatacttgcaaaaatgaaaaaataaacacaactgtataatcatgaaatgtatccagaaacatgagttactttatcctagtcataggtatgttatttgaggagttttgtataaacaatataaacttccatgataaaaatgtctgtttaccaagatatttttgttttacatgaatactcctacttagactatttgagctacattttggtgaggtatacatgtgtataaagctttcaaagttactatcatctgtaattaagaatgactcctgaaataaaagtactagttgaagaaaaaactataataggccctatctcccctgtctccagcctcaggatgttgtaaaggataagcgtttgttattttgaagatttcaccagtatttctgtcaaaacttgcctgcaatttttgaaacaactgtacaaatacccatgtcagccatacaacatgtactggcagtttaaatgaaatggttttatatcttctcacaatggaaatgcaaaatataccattcaacacaataaggacagaggagagatgtagaggaggagcaatattgtaacagctatttcacaaagaaatggcaccactaaactctaaaatgaaactgtgtgtaccctgaggatttttcacttctgggcactcctatcaagtcccttctgtaagcttctctctctgccctccccttcaaggctgttgttcccctgggtgtcacacatagccctttcatcttctattctacgcattgcccttgagaaatattatacacttatccatgcctttaataattaatttgtaactgatgaccccaaaagctttatcttcagtccattcctatcttctaagcctcctaatcctcataatcagtagcccgttaaatctctctcctggcatatctcacactcatctcaaacagcatgcctaagctcaaactcataatctcctctcccacatatattcctcacatatcccctatctcagggaatggaataactctatgtgtgatttgcaagccagaaaccatggagccatcctaaataactcctggccctaaatctgctcaaacccatatccaattgatcaccaaggctgtttagttctcacacctaaatgtatgttgtattcatccatttgcactttactattcccactgcagctgtcctcattcagaaagtcttaccagctgttttatttaaatacaagccaattaaatgattttattttacattttctaacctgttcaaagaagattattacagagccaaatatacagggttttatggattaaacgagacgatatatgctaatcccagggcctggcatataattgtggcacacaatgccagtggcctagtcactacccatttacccttcctcacttaccacaagaaatccaattttgtgggaagcacccagcaacctaatgaaaaatactcatttctacagacatctttgcatttctgtaattaagatagaagctttttttgaaggaaaactaatatcccatccctcagagcaatagagatgaaaagaaagcaccattcattctttactacagtaataatgcttatcacactatagctttttgctagcaatacttaatatggtctgaagccattagatatctcaataccagtaggaaactctgttaaaccccataatatccttttaaagtaacatcgactctattttgcagacaaaaccacaggtgcttttatatgcttacataatattgtctttagttagcatggattcattccttaggtaacaaaaaaatacaatcatcacctgttctagaagtgcaatataccttctttaaaaaaagtaaatgggttcttaaaaattgacctcatgaaaatctcttacctaattgcccatgagtctttctttctagctctttactctcaaaatttctcttagatacccaagctccttctttaccttaactctcagtttctatgtcttgcacattttattaccatatcatctttcctatctatcccctccttccattcttatttctctggtctgggcagagccaccttctgcttgaaattcctcatgagtctcctgcctcttctctctaatcaagtcccaccactcccaaagcaacttacctaacaatcaatttgctaggtcaacaaccagcactgactctctcaattaaacgaaaacaacttagtctgtttgtcaaggcactccaggatatggcctcctcctgcctttccatccccctcttttaacaactgaggacaagcatcccatatctcaggcaagagggcacttgctcatgctttgccctcatgcctacctgggtacacatacaggagatatgattacttccattccagctatctttctacctaacagccctcaaatcccctcaaatccctttctacttctccctcaaatcccattctggcaatgagtttcttagtttgtttgtgtgtgagtgtgtgttttatttttgttttagtagactttatttttagagtagttttaggttcatggaaaactttaactgagtgtacagagatttcttatatacctcctgcccctacacatatatagtccctccccattatcaacatcccccaccataaaaaaaaaattgttacaaatgatgaacctacactgacatctcattatcaaccagagcccacagtttacattaggattcactgttggtgtacattctatggtttgggcaaatacatagagacatgtatatacaccagtagtttcactgccctaaaaatcacatgtgcttttcctattcatccttctttcacctcatttgttagtttttttttttacaaccctcagagcagcatatattctcaacatgtttcctatttttgattctgttactatttgtatgtgtttcttccatcattactgattcaagttatttaaagttcaaaactgtatcttgtcttctatatattttctgctataagatagatagcatctaagatagcaaatgttaagaatatttattaattggatttttaatgaaaacatacactttaatgggggatatttaaagaaaaccttttataataagccaaagagccattaacaaagtaaataataatttcttatttgtcttgcatatagatctggattttacttattaagggttttcatttttacaacagaatatgttaaaataaataaaataggaaacaaagaggttagaaatatgctcttaggttagatatctaaaaaacaaaagagttgtgtatttgagatgtttttacatatcatatatctacctacttctattcatcctgccccagagaaaaagtatttgtaaaagaacttgcttggactttgaaggcagaccagagttaaaatcctagctccactaactggatgatttggagcaagatatttagctgccataaactttcatttttttctactactcttagagttactctgtgtgaggactacatgcaatagtgtatgcaaagtgtagcatatagaacctgtatgaagagaagccacgacacaaaaatgatagcttcggaattctatcttacactggaatctctgtggtatcctgaataaggtgccagttctccacaaagcctaacgtcaacaatgataggactctttacttatttctccttccttataataaaaccccatcaactgaaggggatggagaaagaaactgttacgtagaaacttcctttctctgaaataccagcaaagcagagaggacactcactggaaaactaatgatctttataattacagcaaaatcataatctaggtaactattttacctttttcactggaaatatatagaataggctaaataaaatattatcactaataagtataatattaactactaataaaataattttcataggccacttattttttatgtagagtgtatcttctccctataggtttctagaagagataaagtggcgttgtaaagattagtccatgatactaaatcaagaagaatttcaaattcagtcatacttttttttctctacccacatgcaaccctttaaggcttgtggtaaggagaactcctccttgttcctaacaagaacttcccactcttcttaaggtttcccagccccagttgcttacgttatcttctctacttgaaacagcctgatgtcagacatttctaacctaaagctttaatgagatttaaataatcgtcatactttactactactaaaggtgcttgtatttacaatattttctctaaatattgaatgaaaaattcttttctcccctctctgtgatgaaataaatatttgtcattgagcagaattgaataaaaatatttatggttaatttcctgacacggtaccagatttacagtcgctcctattttatctacagttgaagtcaaataatgtcataaatctgtcccctcaactcacacttaagattcacttctaaaagaaagaaatagaattcccaaaagataaatgcttttgataacttctcatgaaatatagcacctctttggctgatatacagccatagtgtgctgcttctgtgatctgttactggtttcaaaattagtggtattctgggagactaattaacatcattagccacaatataaaagtttggaccattgcatttagaagaatggcctcttgatatcaattattttataaatatgaaacatgaattgagcatgtttataacaacttatcaacctgcataaataaacaaataaataagcaaataaatacccagctagatttaatttttataacaacaatagtcctcaaaatcatgtcccaaattttatttaaaactgattcaatttttaaaatctaatagcctgatgatttggtacatatgttttgaaaactagcataaggtgccttctcttaaatgctaggtcctcttcccaatcctcttaatactaagattcacactgggaaagatattttgtaaaatatgtgtatttagaaacttcgcaaaaaagtttcattggccaggtttgctacttggtctaatgccttgatgtctcacaaggccaaatttattatccatggagggtgggaaggaaatatattttaaaaatccagacaactcaaacataggcaatttggagtggaaatatgctaactttcttaaaatagtaaacccttgcaaaatgatcctatctgagggaaagtttagcctaagtaatgaataaaacaaagttagactatatttaaaggcatttagatgtcttccaataaactagcaatttatccaatgagaatatgagatgggtgggtggtgcattgttttagctactcatgaaaatggtttattaaattaagctaatgaaatagaaatttaaaacctatgaaagtattaagttgtgtaccaatccaagcaaaagtaaacatgttttgtctatttcccccttctcctgaaactgtatttttttattgtttgttaaccttctgtcaatattaaaaatcttatattgcttcacatactcttgtttgtgggattttacaactacagctgctcacctctcctacttgaaactctcccaaagctttgatttctatgactctacattataataattcctcactcatatttctgtattagcatagactcatttttctcaattcttatctgactcctcttctaccattaacaatgtggacattacacatgactcaattctacccaactcttcttccttctattcactctctccttcagcctctccaacctccacaggtttaactaatatgttaaggtaaatggtcctcaaatcgatcactagctttaacctctactatgaagttaggcattgctaactatgcaggatatatagttacaaataactatatatcctgtatagttagtggcttccaaatttcctgatagaatagtcatctcaccagacttaaatctagactaattaatcttctagtctcaaaataattcacctgatatttttatttctgtttattatagcatagctttttttctttcatccatccactatgcataaaactttagaaatgtccctgactcttctctctgcccagctctggcatttgattacttgcccagctctatatcttccctaatacaatatttttcaaattcagcttttcattttgttccattgtcatcatcctggatgaagttcttatatcattattatgttttctaattttcctgtttctacctgccctagtaaattgcctcctatttatatccactagactttcctattgcttacaaaatgaaatgtaaccactcaaaatcctcttaagtatgtcccaattcggtacctggaattttttcacatacacagtcccaagctaaattaaaaagactctttttcagagtcatcatctttgccatcccccaccccaaaatgacaactgggatttccttttcctaaacccaaactcaacctctacattgccttacattacttcaacagtcaaataaattccagttccttcacagaactccctttcacctgatctctatcccagttggagttgatctcctcttgtcccaaatgcctatcgtaatttctctacatgattttcagcatctgagcacatctactactgaacagtgaatactctgccataatatgatgtcaacaataatttgataaagactgcttaataaacagtctccaaaaatactgttttagcccttattcctagccaaattaaatgccaatcatctttatacttaaattgcctagcaaatagtatatatactgctgatttcccaatgatcaaattccaaattagtatctgcgttaatgattttaaattgcctagcaaatagtatatatactgctgatttcccaatgatcaaattccaaattagtatctgtgttaatgagggtttattatagcattacacaattctagttaaaaataaatacgaccataggtgggatttgaacaatgagaacacatggacacaggaagggaaacatcacactctggggactattgtgggtggggggagaggggacggatagcattgggagatatatctaatgctagatgacgagttagtgggtgcagcgcaccagcatgtcacatgtatacatatgtaactaacctgcacattgtgcacatgtaccctaaaacttaaaagtataataataataaataaataaataaatataatcatttgttcttttggatgatttcaaaattaatcaggtataagcctttatttctcctcaaatggtagaattatgatgcacgtttttaataaactattttaatcttcttgctttagacaacaagaacaaagatatctttcaaggggacttatattgcatcattcaaaatcacttcaaatgaaggccacaagtttcactttgcagaatccaaacatctgttcctccctaaatataacccatgaattatatttctgtaagtctatagcttttattaaaggatacagaccggagcagaactcccagggtattaagaacatctatcctgtagcattctatctttataatgacatgtagattttccatttaaaaaatccttaatttaaattatttagaaataatgtataaaatagctcctggtgtttaaatttagagctcttctagaagtttaatctaaaactactccttaacttctaagtattttcatttgatggaccactgagtggtttttaaattttatttcctgcttctaactcttgacaatttattcctttaaggaaagcaaaaatactgtcagtggtcatgtcgttctcaacaaaaatgtattctagtaccattcactctagtatacaattcagtaaactgaggtctatgttttagctgtttctaaagaaggacaaagagaatactgacatttggttatcttaccgataagatagtcctatgacacatatattgaagacattttattttgaagctcaactgaatgactgtgagttacagacagttttatatttactgatatactttcatctaaccactgtgaaattatgaaaagaaaatagtgattgaattattttctgtctaattacatggctaagttaaagtttattcaagtttggagttttaatttcagatagatttttccctcattgctattgtaatcctcccaccacattgcatattttcaaatcatccagtttatttttcctcttgctgataatataagtcacctccctgtgttttttgttactctacagatgtcaaagaatctttatgctctttattaatacataagatgccaatgccatacatatcatttggattattgttccagtttgcaggtgtgatggacagcacaaaatcaaacacgtaactgtgcccttcagtctttaaaatgttcacgttttatggaagctttggaatgtgttaatgattctgatttctggatataacaatttgtcttactgaatattaaggaggcggcattagggcaataaagtattaaatgttaaataaagtattaactaataaataaaatatttattagctaatagacactttaaagacatggtcttgtttgatactcaaacaaccaaagaggtacacaaccttgtctaagtttgaaaagaggaaaaccgaaatcatctagtttaggacgcttcttaatttcttgtaatcagaaaattatacaaattgattttgaacccaagaccaatttctgtacttgcactctctccaccatattcagataaataatttaggaatttaagaaaagtctttttaaaaatcgtacacttattagagaagcaatgacaatacttccacctattcttatcagtcacctatctgagcaggtggtttacacaactcttttcacaagagaaggggcataggctatgatgctataggtatagctcaatgtctggcctttggtctctatgtcttttgatatagaagccactgagagtttgcctacattcccagaggctcaaagtgatagctcccttgtccttatgcccatatagtagcatgcaacttctaaacagaggagctatgagatcacctatttcaaaagggatttctgaattatttctgccttagcccacaaagatatctcactggtgcattgaccaaagtcagttcagatgctctaaatgcaaaaaaacacttgggaagcaagagtcaaatgtagtaccaaatactctctccaaatagttacattataataatttcaaaaaatatgtacacagcaggtattgttctaagtactgtgagaaatgcatacacaaactatatgcaaatactgccttcaaggagcccctcaaaaatgaagacctaatctgcctaatatgaagaagttaaatatgactaaaagagaatttaagacatgttcgtaaattgcacaccataggtactctgggtttccaaaagagataatcaattggtcaccttttaagtaagttctggtattaaagaaatttaaagacagcatttgctaaggagttccgggggttgcatggcacaaatattaatttgtcaacaaatatgtgctgcttcctgggcttgccactatgcctccaaagagaattagatacagcctaatcctcaagaaaacatgaacaaatcaataatgtcttataaaacagtacaagttctaggttaggctttataaagggcagtcctaaaagacacaaaggagagtgatcaagtcttctgtgtacatgacaacactgcaaacattcattgagcagcaaacatagtgctagtccatgggttgccaggaggaataccaagagaactagaaacaaggtggagataaacggattaaattgcataaaagttaaaaggtctagtggcatatttactttttcagctaatgctttagatgttataatataaaataaatccaaggctatcccaagagtttgctcctaatatattttcaagtctttgctttcccaattaaaatgtaggctcatgatcaaagacagccaagaatgtgatcaaataaaatctcaatttaaaaagtgttaagttctgtttataaatttcataatatctttttccttcaaaatgattttctaaaataatcaacctctacttatttatgttaacaacaaatttttgaagttaaatactactcatttctacatatttagtgtcctacagggataaataagaatgccatttctatctagtatatgttcttttccctaaaacagtatgtttaaagatgttatttgatattatactgcattgaagttttcacccactggcagctgcgtattatctgatggagcagaatgggtgatgtgtcaaggaagaaaatgattctaccaggagcatatgtttccaggtctgtaacaaatatcgagggtgtgtgggcagaccaacatttgctgtggaatattaaagaattaaagactgagtttctttaattttctgagcaattcacaccaatcctacagcatactttaagcagaactgccagtatagtgagaaattttccatcacttacaaacgaattcaatgaatatccactccaattcactacagtgcccacaaagaactcatgtatgtatgtttctgcataggtataacaagaaatgtttttgtcctatcttctttcatcctttccttcataatttagtggtacttattaaatcttttttgcttcaacagaaaatacacatatggatgatatgatgttgctcaatagataacagaatcccattagtaggcagatgttgcacttgctttttttatgtaggccagtaacttagaggaaatttttaaattatttataaatttactaagttctgcaaaaaggttttgtaatttgcacattttggctcactttttaaagatatggcttctaccagagagttaaatcatgagtgaactcccatttacaattgcttcaaagagaataaaatacctaggaatccaacttacaagggatgtgaaggacctctttaaggagaactacaaaccactgctcaatgaaataaaagaggatacaaagaaatggaataacattccatgctcatgggtaggaagaatcaatatcatgaaaatggccatactgcccaaggtaatttatagattcaatgccatccccatcaagctaccaataactttcttcacagaattggaaaaaactactttaaagttcatatggaaccaaaaaagagcctgcatcgccaagtcaatcctaagccaaaagaacaaagccggaggcatcatgctacctgacttcaaactatactacaaggctacaagtaaccaaaacagcatggtactggtaccaaaacagatagatcaatggaacagaacagagccctcagaaataacgccgcatatctacaactatctgatctttgacaaacctgagaaaaacaagcaatggggaaaggattccttatttaataaatggtgctgggaaaactggctagccatatgtagaaagctgaaactggatcccttccttacaccttacacaaaaattaattccagatggattaaagacttaaatgttagacctaaaaccataaaaaccctagaagaaaacctaggcattaccattcaggacataggcatgggcaaggacttcatgtctaaaacaccaaaagcaatggtaatgaaagtcagaattgacaaatgggatctaattaaactaaagagcttctgcatagcaaaagaaactaccatcagagggggaggagccaagatggccgaataggaacagctccagtctacagctcccagcgtgagcgatgaagaagatgggtgatttctgcatttccatctgaggtaacgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgagggacgcacctggaaaatcgggtcactcccacccgaatattgcacttttcagaccggcttaaaaaacggcgcaccacgagactatatcccacacttggctgagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagaccagtggttctcccagcacgcagctagagatctgagaacgggcagactgcctcctcaagtgggtccctgacccctgacccccgagcagcctaactgggaggcaccccccagcaggggcacactgacacctcacacggcagggtattctaacagacctgcagctgagggtcctgtctgttagaaggaaaactaacaaccagaaaggacatctacaccgaaaacccatctgtacatcaacatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagatgatcaaattactctgagctacgggaggacattcaaaccaaaggcaaagaagttgaaaactttgaaaaaaaattagaagaatgtaaaactagaataaccaatacagagaagtgcttaaaggagctgatggagctgaaaaccaaggctcgagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgggaagagaaactccaagacacataattgtcagattcaccaaagttgaaatgaaggaaaaaatgttaagggcagcagagagaaaggtcgggttaccctcaaaggaaagcccatcagactaacagcggatctctcggcagaaaccctacaagccagaagagagtgggggccaatattcaacattcttaaagaaaagaattttcaacccagaatttcatagccagccaaactaagcttcataagtgaaggagaaataaaatactttatagacaagcaaatgctgagagattttgtcaccagcaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataaatggactaaattctgcaattaaaaaacacagactggcaagttggataaagagtcaagacccatcagtgtgctgtattcaggaaacccatctcatgtgcagagacacacataggctcaaaataaaagcatggaagaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacatacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacggtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaatcgacaccctaacatcacaattaaaagaactagaaaagcaagagcaaacacattcaaatgctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactagaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatattacaaggctacagtaaccaaaacagcatggtactggtaccaaaacagagatatagatgaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatccctttcttacaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaagagaagacatttatgcagccaaaaaacacatgaaaaaatgctcatcatcactggccatcagagaaatgcaaatcaaaaccactatgaggtatcatctcacaccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtctattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggagggggagggatagcattgggagatatacctaatgctagatgacacgttagtgggtgcagcgcaccagcatggcacatgtatacatatgtaactaacctgcacaatgtgcacatgtaccctaaaacttaaagtataataataataaaaaaaagaaaaaaaaaaaaagaaactaccatcagagtgaacaagcaacctacaaaatgggagaaaattttcacaacctactcatctgacaaagggctaatatccagaatctacaatgaactcaaacaaatttatgagaaaaaaacaaacaaccccatcaaatagtgggcaaaggacatgaacagacacttctcaaaagaagacatttatgcagccaaaaaacacatgaaaaaatgctcaccatcactggccatcagagaaatgcaaatcaaaaccacactgagataccatctcacactagttagaatggcaatcattaaaaagtcaggaaacaacaggtgctggagaggatgtggagaaataggaacacttttacactgttggtgggactgtaaactagttcaaccattgtggaagtcagtgtggcgattcctcaggcatctagaactagaaataccatttgacccagctaacccattactgggtatatacccaaaggactataaatcatgctgctataaagacacatgcacacgtatgctattgtggcactattcacaatagcaaagacttggaaccaacccaaatgtccaacaatgatagactggattaagaaaatgtggcacatattcaccgtggaatactatgtagccataaaaaatgatgagttcatgtactttgtagggacatggatgaaattggaaatcatcattctcagtaaactatcgcaaggactaaaaaccaaacaccacatgttctcactcataggtgggaattgaacaatgagaacacatggacacaggaaggggcacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaaaaagatatggcttttacctttgggtaatttaagtgacaggctgtgtatctggtttcttcaacagcttaaaaagcaaacaacaaaaacagaaaacttgtgaagaaataaattctcagactctttttggtaccagagagatacttggaaaaaaaagtaaagactcaagaatggatcttataaatgcatcaaaaatagcaattcttaaaataataattttgttgtgtttgcagattactaactcaaaagtcattatttcaaaacccatatggtgtcacataacagaaaagattaaaagagaaataccaacctatagaatatgtttatgagaattaaactgtgccaaaactcttggcaatttaaaattgatgtaaatgtcttaatttacatttctacctaatctctctaatttctctgaccttttctctcactaatcctcaacctgatcaaggagctttagacaagctagtctatttactcagcttcacacctcctttttaaaatgtcttctgcacaaccgctccctgtaagtacttgtaatactctccccccaagttctcttcttgacattctccatgcccaattgagcttaccaactcctccagcataatcccacggtctctgagccacagtcattgtactctttctgctgaacttgtgtagcctatgaatcttagaatgtgttaaatctaatcccaggacaagtagtggtgcctctagaatatctatttaggtgaaaatgagggggtggcaaaccgggaatataaaaaagtagtttaggaggatttgaagtaaaactgtttccttagccagcatgctgtttttgcttagagtttaaattactagtcaatgaaacatagcaatgtgtcctaaagatatttattcatacttcacataagattacaaaaacatttgtttgggcataaattctcataagctaccccttgatacttctatattaggcaacaaccgtgtcattgttctgttacatataaagaaaggccacaaccacaatatgtacataataaacccaaatgagcattcatagactgaagaaattactctcagacttggtcaggtggcctagtaatacattccctgaatcatgtcttttccttcatatacataaaatattttgtatttttgtatgtatgtggataattgtttttaaaggtttatttctccaactacagtaaatgtaacatggccagggatcacatctatctctacttcccattatattatatcaccattgtctatctaacacagtgtatgcaactacagtgaactccctaaataaattgaataaatgagtggataaataccacagctttaataaataaagacactgcatcatagaatcagtctatatgtgtctgttccttgaatattttattgtttggggcacctcaatatcatgaaaatgcagacaaattggaagatatccagaaaaaatcaggggggtgggaatgattaaggaaatggaaagcctaatgtctaagagaagatttaaaaagtgaaatatctaaaacttggctagattaaagctatgaaaaaacatgacatattccacacatccttgaaggtaaagtgagaacttagtttgatcagtatagtaagaggaagaggaagagccatggaactcaggctgggctcactggtcctacaaacctcacctgctttcaagaaataagccacatagggacacagtaagaatgattgtgggcatactttcaactatcaggagcccctaaagtcacctagtggtttctcatggggtcagagttcaaggattattctctggcctacaatctctctccagagacccatgctggtcctggtgggtagaagctcccagtctcataattgtttgctgcaaaacaaatatccaagggaaatctattagtttcctatactattcattctttgagtaaaaattatatatcagacttaaaaaaaataaaggtatttaagacttacaacccccatcacactgaaaactataattccaagaagttccaagaaaagtaatgagttgaaaaacattttaagtactagtacagtgtcagatgtactataggtttgggaaaatattagcaaaggctgctgacattaacaaatttacagtgaattttaaaacatgcattgaaagaaaatcatgcctaggatcaatctaaatgtctgcaagttataaactcaaacattctagaatactttgaattaaaacttgatgaaatcttacgaataaacacaactaacattagtaaggtgattaagctttatagctctcttgttatgtttcaacttggttgtcaagctactatgacattgtagttcttccgacaatagccatgttcccagttgctaaaaaaacaactcctattcataaagtattttcacagtattaattttcattgcattttctcaccagttctatgagacatataaaaatgtgttgttcattctatgtttacagatgaaaaatctaaaacaattaaaatggtatgtgacttggccaagatcacttgactggttaatggcatctaagatttggaggcagattttctggtagctaacccagggctctttcctatgtaatgtcatgcatcagatttatattgattttgtattttatacctcccaaaatcaaacttttttatgccacaaataatagcacaatttccttatatgcctaagagtagcttaatgaaaaataatctgtatttattatcaaaatagatagctactgatatggtttggctctgtgttcccacccaaatctcatctcaaattgtaatccccgtgtgtggaaggagggattcggtgggaggtgattggatcatgggggcactttcccctctgctgttctcataataggaagttctcacaagatctgatggtttaaaagtgtagcacctcctccctcaatctctctctcctgccaccacataagaagtgtttggcttcctcttcaccttccgccatgattgtaagtttcctgaagcctccctagccatgtggaattgtgagtcaattaaatttcttttcttcataaattacccagtctcaggtagtatctttaaagcagtgtgaaaacggactgatacagtcacacatgcaaaattatatgtttatctctagctccactacagatacatattactgaaaatgcataagattcctatgtgatacattcataatttggatttagatgatagccatttctaaattctgacctttatggatgttaggagataagcaagtgttacattctgtgacaagaacttgacgtaataagcatgatgcttgttttccactttgctattttccaaattaattgctctttcccttaaaacaattttataaaaaaaaaattctgcacttaagccaaaatcgtggtccactagtatcttgttgtcagctctattcatgtttattattgaccaaagcaaattctttggtgttgggggaaaaaccacttaagaacagtactatggcatagttgaaagaagattagaatgaatgtagaagggctgaacttctcatatttagtatacctagatcttaaaatcttgagaaaattcctcctgttctaggtctctatctcattccttatagaaagtgaacccagaaaagttccaatagtttactcaaatctaaaagttttagtttgtagaaattaaccatgtgtcagagcaagaaattgagagagttagagcaactttaaagaaatttaatataaaaaactaacttggggaaggcaaagaagaagagatggagtcaggagtctttgtgagagaaaaattagtaagatatggaattgcctgtacttgaagagaggaagttgaaggagtcaaatataactctcaggtcttatgccagagaagctaggaaatgataatgtgaacattttgagagtagatgtgggggagatcataagttcaattttggagataatgactttaacatgtttcacattcacatggcagaagacagttggaactgtaatattctaaaactcagaagtgatgccaggaccaaggaaacagctttaggaattgtatagatttgagaactgaacctatagaggaacatgagtcctccaaaggggaaactatacatagaaagaagaaaagatccaaaatggtggtcatgagccaagtttgttccaacaggaagatggagcagcaaatgagactgatttgaaaatttctctgagagaaatgtagataaagaacaaacttttagattgatcatgcaaagataggttagcattatgaaagcaatggtaatgaggttgtactgaagaacaaattgcaaacagtgaacaacagtttgtgtggagatacatgatattatagactgtgttaatgaaatggggctgttaacaaatgaaagtcaaagataggaaagtcatagaaaacattttagaataagtgaaatttgattattcttttatttatttagatgagtttatggtgtttcccatccccctctgtaattggaatgaagggaggtgtaaagttgtttcctccttttcaagattaggaaaaacctgattacatttgaaggctgatagtatggaaactcttaataaaaaataaatatgaagagtaaaaatgtggaaaatgtagtcatagatgaagagaaaaaattatacattcaccaaaatggagaaatttgctttcaatcatagatgtaatgtatctgccacacagacagaagaaaaagaaggaaaggcaaatttaggaacaaagtgaaacaaacaaacaaacaaacaaaacccaaaaaactgcatctccaaataacgctttactggagcttttcatttttcttcaataatgaaaaaagttaattgccacattctaaatccaacacatttcatatgttttgcagttaaacaactgaagctaggagagaattttaattccaacttctggccctatgcttctttaaaatattgctaccaaaggagcctataaacatagcagtgcattttccttaagggatgtaggcattttagttcccaagctggaggtcattaagaatcatcctcaattagaaaaatatgatataattttggaccatgcattttttaacaggaataatttcttaaattgtcatgcccctacactattttaatctaacgaagtctcaatttactctgctgtaacatgcaaacatacatttctctaatattcaatctatatccaacataaactttattgctttaggatctgtctactgggaaaaaagtcgtatcttttataggaaatgattaaatccttctttcaatgcatatttttcaaaggacagggccaacacatagactaacataattctaccatgcaataaattacagttaatttatccacaatatcatctaagatcagtttttactaaaaatgtgaagcaaacagcacattttacaaaacagattcaaacaaatattcataaatctcggttactttattatagttactgatacatatgaataacagaaaaaaggaatagccctaaagtacattttatacaatcaaattatttttaatataacaccaagagctttaattccttgaaaagtggcaaaacactaaatgcattattaatcagtaaactcaaataaattcctcagttattttagagaaaacaagtttattttccatatgccttccttaatagccccatcacccttgcctactattctgttatcatcgatgttctgtcctgtgtgtgaaaggcctgttctctccaaactccattacccaaatcccacctgtcattaaggtccagctcaaatgtcatatcccttcactagttctccagaactttccagcttgaagtaattactctgtcctattaaccctaatgtttattaccagcaaatcatgttcagtatgcattagattatctgctattatatattattaaagtactatatatagtactatatatatatagctatagataatcgcttcaccccatccccacactcccactagactgtaagatccttaagagtaagattcatgccttactcttgtttgaatctatttcagcacctaatacatggttacatatagttgcaattcaatacttacattctgagtaaattttgataagtgaggacttatcactttgatgactagcagtcctttgatgattacttgtcagataaaaaaatatgaaggtagaatttagaaaaaagatcaatttcaatagttgtataactatttatagttcactagtaaaatgctatgtaaagtgttccaatataaacaatagttaaatattaagactgtatattttataagtctgacatggttctgttctaagttaccactaatttaaattgagttaggactgtcaaaaatctgttattgttatatttaaggactttatctttacaaagtcactaaatgtaagtttgcagataatagggtttcttctcaattggtttaaagtttataattcacataagatatttacgccaagaaaagtattaaatcctttagttaaaatctgcattttgaaattctttctttcctgaatttcaacaatgtcatggggaaacaggggtggcagagaggaaagaaagagagagaggatgttgtggaatataaattattcaacactgcacctacatgtataaattgatttgactattgcaatgcacttgaccagtcaaaaaacaccatgggaacaatggactactaggcttgtgcctaaagcaaaatgtgaacatgttactaaatcaaatatctactgtgcataaacaaaggctgtcttaattattagcatatttatgcagaaaatactagaaattatattattctcgtacagaattttgttttttaaagttattgttaataataataagcttcaaaagctagaaatgatagtaaaagcttctttaggactcagtgagcttgaacagacagaaggatgttttcagatgccacttgtctacgttaagtacttgctagtatttatagttgtattacaaatgtttattctcaggctatcagtacatatattatcaacccagtttgcaataaaggaactgaattctatcaaaaaattaaaaagtccttagcgaattaagtaaaaaaaaaaaaaaactaaagtagattttgcctgaaaagacttgcttgttgtctgtgtttgaaacagacggttgccatatttaataattcagaaatgcaaatgatgtcataaaaaataagaaaaaaatgttatgcaaaagatccaattttttttaattggagaggcttgtagctttacctatgttctctgagtccttgttaattaattctgccctgagtctttcgctgctaaaaggttgttttatctttttttttaaataaacctttgctttagaatagtctcacgtttacagaaaataatagagttcccatatatctcacacctaatttctctatttttaaatattacatcagttataaataatgaacaaatgtttatacattattattaactgaagtccatactttattcacatgtttgtacttttgatctaatgtccattctctgttccagcatgctgtccagggtaccacattacaatttagttagcatgtctccttagttctgcttcatatgacagttttctcagattatttttcttcttgatcactttcacagtttggggggtactcgtcatatactttgtaaaatgaccttaaaaattaggatttatctggtgtttttctcatgattagactgaggttatgggtattgcagaggaatagcacagaggcaaagactacatcatgtcaagtgtatatactatcaacatgacttatgactgttaattttgatcacttaactgtaatgttagtccagtttctcaaatcattatttgaaagaaattactattgacagcctacaggtaaggaatgcacattaatggcccacttccctgagggtataatagctacacaaattatttgagtccccccacaccatttatttattgattcaatactttttatatcagtatgatctcatggatacttacattatactttgggtttataactcaatcctagtttattattcagttgttcaatttgttccatctttggccactagaagctctttagattatcttttcaaattccacccaagcatccctactcattagtggcttttttgagtaatacaattctttgcttatatcagtatcacaagtaggggttagaggtgataaagaaatgtatttgtcttcaaataaagttttctatagctacaattaactgataagacattttaaaatagaccccttaatcaaaggtcacaaaattgaccatatgctctctaccaaaagaaaggcacagcagaatcattctagtactaacttatttcatgaatcatgatttcaagtatgaaattctaatactaatttatttcatgaaacgtgatttcaagtatgaaattatgtgcccctaaataatttcccattgttaattacgtatgttaagtgaaatctcttgtgtaatgtttaaggcaaaataaatttttctctttgacaaaagaccataccaaggcattaagtgaaaaccttttagttattatactcagctttccatgggatagttatgttttaaaagttaatattaaaatgctagttttcattggcttttagttgatatatatgtatatatatagatatatagatatatcacatatatgccttaagttgctttctatgaattatataaattagctctttgggataaataactataatcctaaactttctctagttaaaacttaataatttaaaacaattttatgaggagaacttagaagtctatattttaagtgccacagaactctctgagaaggcagctatcaaaatcactaaataaaaggataatgaataaaaagaggaaaacattcattctaggaatcttctgtgattgatcttatacagatcttctatctacatatacacagtatttgtttataattttatgttaagcttatgttatgaactctaacaaagttttgcaagaatgaaagagaatatttattttgttaattacacaagtattaatataatgccatttattagatacaacttaagaaaatttgtgtcctcttctacaacttacacttaatttaatatcaactgtatttttagtcattatagataaattgaaagccaatgttatcagttgacaagatttttcaatgtcacacatgctgaatgttttattaatacattttagagtacaataaacaatatttgtggaatttaaaataagaaagtatagaataaatgcattttcaataagatatgcatgggctgggtgtagtggctcactcgtgtaatcctaacactttggaaggctaaggtaggaggattgctggaaggaaaccaggagttctaggccagcctggccaacataacaagacaatatctctataaaaaattttaactatttaaaataaaaataataagatatgcatgcatatataagtacttactatatgttgtatgtaggtggcacataacttcaggattcccaactattgctacttagaaaatatatataagtggcaatatggtttcccagaaaatatgacttgatgaccctgatggaaccagtgttctcactactactctgaattttatcacatatatcctgcaagaagcatactgtcacatacctacagataatgtgtagaacccatcttatatcgagtctgatagtagcttggcccccaattcagatgtggcatgagatcaacttttgtcccttaagatatcctaggccagccaagtcctttctctcattctgtctgctagtcacattttatctattacccatacaaacctttgttggctgttccttccctaaacacactggatctcataatgggaattatccagaacactcattctctagccccactgagtcactagtgatccttgattcaaacacatccaaaagccaaaacccaaatgtggtttgagcctatcatctaaattctctctatacacacaggcatgctgaactagtagagaaaaaaatcacacaattatgccaaagatagcaagacaaatttatgttcttcaacatctgccccattttttcaaactggacagtaccttttgaccattccctggaccattccaaagtattaaatcacctttagcttcacaaagagccaagtaaagctaatatgatttcaaggccatctctatagctcccatcacccacttgcatccaagcagtttgttcatttccttccattgtgaacaattatgttataccattagacataaaaacttaaagtataaaagttcaataaagtcatttcagtgtgaatatacttcaatctaaatagcatgaataaatggttgatgtcaggtccttttctgttttaatataagataagctcaagagtgaaaagagaaatgctgtaagaaaaggttggtgagcaaaccaaggattatcacacttcacaacttttccaagactcagtcctgttggtcattgattagatcaagacaaatatggaactgtccattgcagttgtgtgcatgcatccctgcttcacatgatttataaaggatgtgagtgcatgtatgtgtatgtatatttttatatggttgaacttcatataaacaagctttattctcatatttatttttgagatatcactttacttcaaattttcacatatactttgtcacttaagcttttccagtatgacctgctttttcatcatgaatattgcctatgacatcttcaggaaatcaaccatattgtaatatgtgtcttataagtacataaagaatatagacataacttgcactagacaaatacacacatatatgcataagcaaatctatatacaccttatatttttattggtcaatcagatacattagagatcatattaagtaaagtatatccataattatactattaaaatattttttatttgtatttctgtacaagaaaatcaggagaaaaatttttaacatgttcagagcaagatatgtttggagcatgtcttggaacaagacacttaggccattcagataaatgataatggaaggaaactaaatcaaaaggaggtagaagacataaatgctctggaaggaatctgaaataaaatacaggaaagaatagaaggtctaaaataaccagagaatatttgcagtctcaagataatgagatatgaattataaataagttctaagagaatgcaaagtaaaggaatggtcatttacatgttgaaagatttgtgggaaatcttaaccttgaatggaaatatattcaaatacaatcataacagaggaaaaatgggcaaaggttgtgatgacacattatagaagaaatggacatgcagtattatccttgagaggtagttaattattacctaccatctgtcgatcagctatcatctagccatcaatctgtctatctactagcaatccatatatcatataatccaactaatactggtgggaaatgattcaaaatttttttcagcagttgcttcattataactttaacttgccaagtattcagttctgtcttcacagatgcctgaaacatgtggctaattcctatttgtctttgaattctaagttcaactcccacatcttcatggaggctttcctaaccccttggattagatgaaacccctagctctaccctgccacatattaccctgtagtcttcctttgttatcagtgataacctctcattacttcttttctgcatgtcttcctcacaagattggaagttcacaaaaaaatagagtgatatctgacttcttcactgctctactctggttgagcagtggctggcacatactaggtgatcaagaacctgtattgaagcaaattgcctatctgtagagccttgtctaaaggtgaaaactaaatgcaaaagggctggagccttgggggaaatttgagaagcagtgtgcagacatgtaggaaaacaatccaaagagaaaagaaacagagacctccaaaaggggtattaagtgccactaaggggttaaattaaataaattctaggaagtgtgtgttatatttaaaaagaaggaggttaaatgacatttactgtttacttatttggcttgtttaatttcattttgttgttctgttttgtttatttcttcaaggtaggaatgaaagggttacagaaatggtaatacaggattaaagagtaatgacaagcaagagagagaaagagagcgagtaaatctaagttcccctttcttaaagtctgggaaggtcaaacgtcaaccacagaagtagcaaacataactgagagccaagggtttgttttaatttacattaaaatgttttgagcatgtttcttatagagaaagaatttacatttaaatttactcaagttaggaggataaatgaaatgtatttttaaattatccattattacagcatagtctgatcttgaagactggtgatacctacctcatctttccaaagattaaacacatacacacacacatacacacacacacacacacacacacatacacacacacactataacgttaaacagaaaagttttagtagcattttcccaaattctccagtacatctgtttctttctaattctgtttggggttcggcttcctcggattatttacatagctctacagtccaaataagtgatggctacttatgaaataattattttggatgcagtgattcccttaggtgaaatatcctgctatcagaccacaagaaaccagaaggaacagtctcagaggtacaacggtaccatagttaatggaggaatttcttgggcatctgccatctgaaaccgtatgcattgtttcttgcttttctcagttgccttttctttagcagactcaaagtctaataacaactctcctaaattttaccaagcaattgtaatccattattattataataaactccaatttataagctaatacataacatttatatagtggtagattgcaacctaatgacaaacactgacctttttgtataataactgcgtctctcctcaatatttgtggctaaagttttagagcctccttctattttcatgtgcctcccaatgacttcatcgtgagtacagctcttctttgctattttcatttaaatagtctgttcattttggtacttaagcaccaccattcaaaaggatacagaaacacataatgaaaggaaattaaaagtatttctaggaagaatgttttcattggttcttgtagttttctggagtattaaacttaagtacagtctaaagaagttttgtttcttttttacatgtcttcctgaataagaacatttctattttcaagatttgcccttaactctttactgtcaaatatttaacattttgcaaaaacaaatgagcatctgaagtagttaggttttaacacataggatctaatccaacatgatgaactacaaatgaagctcccagaaaattgtagccaatctttgactaaaaaggcaccatttcccactggagaatatcacctaaataactagaattcatatacccagaacaaaaaatatgtataattcctaaaagtgtataaatttaaaagtctgagaaaatgactaagtcattggatcagcatatgactgaatacctctgggacaaagcatagtggttaagatattgggctctgagccaggtctctgtgttcaaatgttagtttctccatttataagctatcattataactgcctaacttttccatagttcagttttctaagctgaaataggaaacaaacagtacctgtcatagggttgctctaaggactcagtgaggtaacagaaataaagacacctggactagcacctggcacctagttagaacttagcagctaatactgcatttggaacactttttgtagaatatctcactgactgtgttgcctttcccgtgtgaccagttaaaacaacatttcagcaggaaatcgtcccccagctaaataaatgtaaaaataactatgatggagaatgcttaaaatctctacttattttgggtatttaaaacaacatagaagcatgcatttcaataaaaatgacagtatttctagtcacacagcgtattttgtgaacattctaactcaggtgaagtcatggaaccatctcaagtctagttattgattatgaaagaatttaaatatgtgagtgttggactggctttaattgataaaaaattgtactttcaatacaaaaagtagatatttaaaaaatcacatttaataaaattgtttcttgggagaaatgctattttcaaatgtcactagcttctaaatattgccttacatggctgtatttcgtaaatgtctatagcaatgggcctgttgttgctgtgacactgatttaagaacacattttggtcattactatctcttgctgtttgcctgcagtgagctctcataattagggctgaatacactgcactattaaaattaaaccaagcctctgggaaagaatcatggaactagatggttaaaggacacccaggcaattaacaagcatgataaagttaaaaattgaaaataggaaagtaggttaagagcttttctctctctttccaacatgatttgttgatacagaaggaatatatatcagttttattttacataggaaagaaatgtaaaagcagtgccacattgcagtcaactaaattattttgctgttttccagtggatttttctctttgtacacttagaagacgtgcaattctaaaataattctacatttgactgactttcaaaacaagcctgaaaatgctttacgctttctggaatcacaacagtgtaacaatgaacaagtaaagaattgctattttataaaatttatactaaaaaagtattgattatttatgatttgaatttattaggcttcctcaattccattacataatacctcctttctatttgaactacatgaaccaaataataaaaagatttgcatcccaaaatgttggtagccatgaaagttttcactcttcagaaaagagggaaaatccattcaaatccaataaaaagagttaagattctgatccttctgagactatgtctgggatattttccctgcataaagttgcattaagtttttttgcctcagtattattagagttttgttggaaatacaaataagatctgtgagtaaaacagaaagataaataataatattgtactgtcctttaattatagccttgatctttccttttcaaaattaagacctcttcctttttccccttcctttttattgtgaggctcattaattaaatagggttggtaaaattatgcttttctaattatattatctcttcatgtattaggtgaaggtaggtaatcattttttacatcattatgaactcaaatttaaacatctgatgggtttgaaatcatagaaattcttaccctttttgaagcttatctttggcttcttcaagtgggatcctgattctttttgctattaccctggtagtctttgataacctccttaatatctggtatgtcaagtttttccaggctcttcagatacattgcctgcccaagaactgggatcacacatttctcctcttcaaattaaggcagaccaattgtgcaaattccatcccagtttcagctgctgttccatcccattcctgttggctgcgtgggagtctcccatattctcagctttgtcagacacccttgcttaccactgcttccttcctccaacacatagcgcaaaatcaggtcttgcagttgttgaaggtttgtgtcacttatttttcaggttgctggggatagttttcctgtaaagttgcccatgattttttgtttgtttgtttgtttggattttgatcttgctctgtcttttatatgcaaaaactaagctgacatcttagttttgcatcttttcagactcaagttctttttgcttttgaaaatcatgtcaacttcaatttcctttactaagatctatgatatattttctatttacacaagggctaatttaacactgctcactcaggacgtttttcactggaatattatttcttcactgtaaatttggtaaacacgataaaaaaaaaatcctggtcaccaaaaagttaaaatttaaaaaaatcctttttcaaaatattgactcaatattttattaattaagccaagaggaacataatgttacctttccatccctgtacaataaggttttaaaggtgcactgttaaatcaaatagcacaatttggcaaagtggaacagaaaataaatgatacatacctaaaagtaatgtaattatttctaaatgtcattgcccaaagggatacattctcaactttattttgattaagacagcactgattctaaaggcaatgacatttaaatagtttttatagggctgtgaaagaagggccatgccaaatacaatagatagaatgtttatgtctccctaaaattcatgtgttgaagtcctaacccacatgatagtggtgttgggaggaggggcctttgggaggtgattaggtcatgaggatagagccttcatgaatgggtttggtgccctcctaaaagagatccctcaccccttctaccctgctaggttatagtgaaaagacagccatttgtgacaagcagactcacaccagatagcaaatcaaccagcaccttgatcttgcactttccagcctacagaaccatcagaaataaatttctgttgtttataatccacacagtctatggtattttcttatagcagctcaaaagaactaagacaacaagatatcatatatatatatatacatatatatatatatatacacatatatatatcccaattttaaaaactacataaaaccaagcattatagtaaatagagctcatagaaatatgcatttatttaattgtaatggcttcaactcttatttccaaatgtatgtttctgtgaaggaataaaatgcagattaaatgtccacactaaattattgttttttatagggcacatagggaaaaaggttgttggaaattatatataaaaaccaaagttaagcataatattgctaaaagtctctttattttttcaaatttattaagtgcctactttatactctgcttacttctagctttgggagcctgggagtgcagtaattcaaacagtaaaaaaacaaacaaacaaaaaaaagcacctcatcttagtgggccttaaattccagatggagggggtgataaacaatactcgaagtaaagaaacgaaacattaagtatgataaattgtgtaaattgtgacatgttctatgaaaaaaaaggcagagatatgagaaatagatgataacctggagtttaaaatatgttgaaattttaatgagattatatttgtttataattttgtgctattatgaaaaataccacaggaatcatctttgttctcatgtctttgcaatcttgtcatattttttctttacaataacttactaccctatacattttcaatatttgtaaaatataaagtatcaagctgacctttagaaaggttagaataatttacagtctttagtgtcatatggtggcaagctccccctccatagctttattattaaataattcactaatatttttctaggatttctgatttcagttatttttaccatttataaattaatttttttatttttttttaccatttataaatttaaacctaactttggatttaactttgctgaaaaataataaaaatggattttactcaattatttcagtaaatcatttttctaattccaaattagggtatatagcttatgtttttagtttttttagtcagtgattttcttttcttttatagattccaatcattgttgatatataggaaagttactgatatatcttaatgtatttatcttagaagcagccatcttactgaacttagcagttaactccataatttatctgttggttcaatcaactctttaatgttcacaaaaaataatttaggttcctttcacccaagtatatttctagttagaattgtgtgccttattgtattgcctgacctatccagaacaagtctctcttcaattcctgctcaccaggtagctagcctcaaaactaaaccagttgtttatagagaattctctccctctcaaggaaactccttctagccagttaaatatatatatatatacacacacacacacatatgttttgtcttttttttttttgatacagggtttcactttgtcatttagcctggatggagtgcagtggtgtcatcttggctcactgaagcctcaacctgctgggatcaagtgatcttcccaccccagcctcccaagttgctgggactacaggcatgcatctccatgcctgcctaatttttgtatattttgtagagacggggtctcgccatgttgcccaggctggtctgaaactcctgagctcaagagagctgcccgcctcagcctcccaaagtgctaggattacaggcatgagccaccgtgcctggtcccgcttcagctataattcttaagtagcttgcccaagcaaaagtctctatctttgaatcgtccatacactgtttttagtgtctctatttcttcatgacaatattagatagttcaggaagtcttaatttgggttccaaaaataaatgtgcttcaaggaaactacaaatctttgaaattacaggcaaaatattgtaaataaatgcatgggtcagagggtcaatagctttaatgtgatttgtgaagtattttatgagtcttcaagcctagaatcactaacacaaatggctaatcatgaatgattagtataatcagtaattatagccaatagaattatgggattatttatattgtgcaatacttattcaaccataacttggtgcttctagcatgtatttctgctttttatacattagatatatatccagatcacagaaaatacaggtgtccaaacttttcattctaattcacttacatggatattcagggtaaatatcaaatttattgtttagaaaaagagacaacttttaaaaaatactatttaaacaaagaatgactattctataggaaaaataaggaacagttgttctccctttaaaaactaatcaaataggccaggcacggtggctcacgcctgtaaacccagcactttggtaggccaaggtgggtggattgcttgaggtcaggagctcaagaccagcctgaccaacatggtaaaaccccatctctactgaaaatacaaaaactagctaggtgtggttggtgcatgcctgtaattccagttactctggaagctgaggaaagagaattgcttgaacccaggaggcggaggttgcagtgagccgtgatcatgccactgcactccaccctgtgtaacaaagcaagactctgtctcaaaaaacaaataaacaaaaaactaatcaagtaactttctatattcattttttcagtctctgctcatgttcctcaaacaacctaggtagtgtaaattttaataaggtgcattgtctttttaataaaataaggctaaaacattctgcaagggtataagtgacaactgctctagaaatgatatcacaaagatttcttttaattctgtcaaatttatagatttctcaaattcttttacgttcctaactagaaataattatatttctaaataacaatttttagactgttaaacatgacaataaaaaagaaaaggaaagatttatcaggttataactcatcttatttgcctcatatgtaatacttaactgatttgaaataacatcccaaatggtttaactatgccattttctgatgaaaagaaagatgaacagaaagtagcacatgcaacccaatgaatgccattataattttccctaaaagctatttccaaatgttcaatacggtagcattctataccaactaaagagattaaactggaaaattttgcagaaacaggatatattaaaagttttccgtccggaagcagtgtctcatgcctgtaacgtcagcactttaggaggccgagccgggcggatcacccaaggtcaggaatttgagatcagcctgaccaacatggagaaacccatctctaacaaaaatacaaaattagctgggcgtggtggcacatgcctgtaatcccagctacttgggaggctgaggcaggagaatcgcttaaacacaggaggcagaggttgcggtgagccaacatcgtgccattgcactccagcctgggcaaaaagaacgaaactccatctcaaaaaaaaaaaaaagttttccagtgctaactgcctcatgactagaccaatttcacacagcatatataaaatatggcattgcacatcagggcttctgctgccagggattgcatgaaggtaaaaaggaaatagcagcacaccatttacatggccattccttcatatatttttttcttcagaaattatggaaacggttagagtatgtacttagagaatatttaatttttcaaacaactaacatgccttaattctgttttaattttacactcatacaaataactaactcttaaatagcattaaatgcagagcataacttctaagcactacatatatagaaatgtttatatagcatatacagtatatatacacactatatatactatataccccatgaattttacatatatatatatttttttctattataattgagaaaattaaggtccagttactaaggtggtgaagctcagattctgacccaaacagttcctaatattgttacctcaaaataatatatgcccagtcttttttttttttaagcaaaacagcatcaaggattataaggagaacatataagcctctcccttttccttttaccctacatatcactttccaaattcaaccaccataattgtttcttttagtgtttagttcatatttcaaagacaaattaatttatcaattttaaatactattcattagctgccaactgtggaacacaaggacttagctttctgacatcacccaaaccacatttacgtttctcctgccctcccaccaacctagaataattgcaccacaatctttatttaaaacagtcaacttgtttacattattatgaccaaataaccattaggtactgttgaaccaagcaaggaactgtgattcttttcccttttttagacacctttagatcattctggagttaataaagttcttttgtttatttacttgtctccaatgtactctacaaaatatgaaagtcatcaatatattgttccaaatgatctctggaacacctagtaacattatttatcaaatgctgatatccatctatttgtttttcctaccctgaaggccttcctccagaacgctttgctttaccgccccagtctggactggtttctttcaaggctagctattttggagtactcctgggacttcaggtttctctgtgttagagcccatttcctagcttctatgtcttcatgttgtttggtgtaatttcttgttttgcaggaacatgtcatctaataactttctaagaaagggtacatgggtagttaatactagagttcttaatttctgaatatctttatttaaattttgtattatggcaaggtatggatttcttatggagattactttctctcagaattttgcagactttgttacatcgtcatttaccttaaagtattattcccacttcttgatatgtaactttttctttgaaaagtcttagtcatttgtttgtttgttgcttattcaatggtgttgtaaagcttctgtgtaatgatccttggacagtctttttctttcatgatgctaagtattccataagttcctcagaacagacatttcagttgctgctatctggaaaattttatcaaaaatgtctctattaattccatatgtccattttcacttttttatcattctagaataccttatggtagattttgaccttataaattagttattggttttgctatattttcttatatttcctattcccttttgtctttttgttctaattctaacgggcttcctagactttatctgctaacacatttcatccaagagctgttttttaaatttcttactatttttttcatagcaacgtgttcttattgtgcagataaaatatttatgaagatatcatttgtggagtattttttataatactgtcatttctccttatgccatccctctggaccttctttggctgtttgatttagtctttctctgcttgatttagtcttccctcatgagacttttctcaaatgtctggttatcttttgctttcagttccatattaaccaatgccataccaaaaatataatcacagcctcaatgtacacatgcgggaatttttgcagagtgattaggcaataaacatgattttttatctgaagactttgaaatgtctccctttggaggtattttctccagtttcccgactgagaaaaattggcctggctccaagcatcctaatgtgagcacagggagttctgtattcactaaggaaacccttatttaattctgttttcagtctggctttcctggaactatttcataactggcatttccaagtcctgaattcttctggatttcaatgggtgaaggattgtggaagtggaataatttgtccattaacttcctattttacaaatgttcttgagatctatattctctgatgtctcctctttcttctacttaccaatgtgtctgtgctttttcatattattttggagtgacttcaagagggaggaagtataaatgattaggttcaatccatcacgtttcccagaaggtttggagaattatttatactggcagccttgtttcttattatgtaaaagagttgaagtgacaaaattaatattcacaagaactgaattcctggcccagttcttactatctatctatgtcaccatgttcacgctacataacttctctgcagtttcatttattcatctgtgtattgggcagggaaatgtaatagttggggcacatacttgcaggtgccagtgggaaggagatgccaggtattactgtaggaaaaaataagagctttcattgctttcatctgaatttattaactctaagattaaatgttctcatgacctgcttggagaataattctttgtccattcagtcaataaatatttattacaggtctgttatgatgacctagaaatttcactccaaagagaaatgaaaacatctctgtgcaaaaacttgtacgagaatattcatatcagcagtatttacaataaccaaaaagcagaaacaactcagatgtccatcaactgataaatgaataaattaaaggtagtatatccataaaatggaatgttattcagcaaggaaatgaataaagtactgacacaggtaacagcatgaatgaaccttgaaaaaacattatgctaagtgaaagaagccaataaaaaatactatatattgcatgacttcactgatataaaatattcagaataagcaaaaatctacagagacagagagaggattagtggttgcttaaggctgagcgggagggcgggagaggagagaaagtgagtgctaatgcatatggggtttctccttaggatgacaaaatattctaaaattgattgtggtgatggctgcataactgtgaacttactagaaaatattgaattgcttactttaaatgggtgaattgtatggtatatgaattttgtctcaaaaaagctgttaaaaataaaccatatctgtatgtaataattaggtgatgggatgatctgtgcagcaaactaccatggcacatgtttacctatttaacaaacctgcacatcccacacatttacccctgaagttaaaataaaagttgaagaaaaaaaaatgaagcctctaagaaagtttggcaagaaaagtctattatgtgcatttttacaacattgggaatgtaaaactgagtaagattcataaggtagcatggtttaaattccagggaaaggacacatataaaaataattataaattctgctgaacagaaagcctagatagaaaaataagtgtgtgcacaatgattaaatggaaatctaaaagatgagtagaaactagttatgtggagtgataaaaagtgaaaagagtatttcaagcttgggggtaatgtcacattaaaatcttagttgcaggagagaactcaggttgttctaggagctaaaaatttacccaagtggctggaacacagagctggaatgagtggcatgtaatgaggctgcatatatcggctgaaattatgcagggtcttgaagctcatagaaagtttgtccaatgtagtctaacagtaatgggaagttactaaaggttttaaagagcataacaatattattagatttgctttttaaagatcactcttgtcactctatgttgaatgaaatggaggacaggttacattttctgtcctaaaacagcctgtaaatatcataacaggaatgtcaaccttggagaacctacgttattcgtgtcattttaagaaatctgtaaactggaggcagtattaattggtcaaatcaatatgtatagaatctctagaatgttcataggcagtcattccattccctgaactttagccaaaacaatgaagagtaaggtgcgaagatgtttgttgcagcactttttaaaaaatactgaataactgtatacaacaaagctgatagtctaaaatttataaatatttactaactttgtatgtatgtaaaattagccttatgtttttagagttacagctagtgacctgaaaataaaattaggtttatataaataaaattataagttgtaaatttaaagcatgagtaatgttgcttccttgctttaactgcgtggtcaactattagacaaaatagaaaaatactatgagaaaactaactaacataacttgaaagagtcatgaaatcaatcttatcaaagttgggtgaaatgtgtcagataaacactcaactcaaaaataatcaacttctatatatattctttacttctatatatattcttctacaaagtcccttgaatagtttctgtagcacatatatacaaatagaattaacagagccatgaaggtttattttgcaaaaacataaaattccaggatgcaccaggaatcctgatttttttttcctgtaaaactaatggtaagttgtacatccagatgccttcacaaagaaaattatttttagaagaaaagtacttagagaaaatataattttcatagtgcatgcagacttttttctttattatcactatttctacaactaaaatatatagtgtcagcctaattcatagtttgttactcctttacacaaaatgataaaatgaaaatttgtcacagaccctgcaaatgctcagtactcttcatgtagtgctaatgatctgcaataatttgcactgtacttacaagagactctatttgaaagttcttttccggagcccaattgttgtttctaaataatgaagtgaattatctgctaaacacaagaattatattcagaatgataagattatcacctgaaaatcatactaaatgcattctgctggtttcctgctcactataggacataggtgcattgagtataataatgcagaattacaaatactatttatcttgctttgtggtggtgatgttgttttggtttgtggtttttgatcaagcagatatagttgaatataattttcttaaatgaacctatgatacaaataataagtaatatatctttccagtgcatttaaatttctttcattattcaacaggcacgttcataaacccaagtccacataattaaatatgattagtaaagtgtacctctttactgattctcaatttataatcataccccgaaggaggtttaaagggaaagttgctcagaaaaaaatgaaaactatcttataatattttaatagtataaatcataatatctactaaatgcaacagtgaaacatttgctaaaatttaaagttgcataacttacatgtatactaagaaaaagtaactaaataaattcacacgtttaaatctttgaagaaatttcatgttgtgtctaacagttgctagagccactaagaaaaatgtaattgaacttaaagcacaaaaaggttcacctaacatagaaaaaaaataaattcttatggttaattttggctatgttgatatgaaaagcaaataaaataagcattgctggcagatacagagtgtgttcagcacaaagataacataacagtaggctaattcgtctttaaaccctagaaggttgaattgttttcttgtgagaagctcctggaagcaaatgttctctctattatgaactgtataatatgggtgaagcctcccttccctaatgaacacatcagtgatctctgatatcagtacagttgtggctgcaattcaaagcagagatggaagaacggatgtgacggtatcttcaggaagtaactcccatctctagagtccttgagtacttacaacaaaataagcttttcacacactcatactaatgatgaaaagaaattgaaaaaaataagaagtcaagatacaaaactgcctccgttatgaggagcaagatgttggctggcaatacatatggaaaggagcattctttttaaaagtccctttgtgtaagcatgatggaacaaaataatgacagaatccctaaaatggcaaatagtctggtgataaattcttccaagataaattgcttgcataataaaaatcatccacaaaagtattctaaatattctttcaacctatttaaatgattatatcataactatcaattggctatggaagcacaatgcttgccaagcatcacttttaaaccttagtaaaattctagctaattaatataaaatcaccatgaatttttaaaaatcatatttaacctccaaattaaatgtgtctatgtgttgttcacatgaaattcaataagactaagaccatactgtcactacagaaaaatcgagctacatttgtttttaagtaactatccctattttccctagtttgggtgcttatataccacagcataaacaaaaacatgagcttgttgtgtttactaaattctgtagcttccacccagttatttcaaacagtacctatactattggactgctttttactctctgaaggtttctattgtcatcctctgctgaggaaaaaggtaaatacagcaactctgccctacttacgccaggggtagagaaaactacctgccagacacagcaatagcactcttgggctctggtggggaaaagaggcactagctagctctctgaaagtctcagtgggagcacagccttgtcccttgaggtaagtaaagtagaaagctatcagtcttaaaaattatcgtgagcagggaaactagaaacagtgttaaagtcacgacatgccctggagtaagaacatagtaaacttctctggccatgtaaaggtttattaaaagtgtcaaggaaaagaatcctctggatatcttcatttgtaataactccccactcttcatagaaattactcttaagtgtcattcactcagttgttaaatgattaatgaacttaagtttgacattttaggaattgtagtaaagcacctccctgaaataatccttcaggaaagggcctaaagtaaaggctagatcatgaccgcaaaaatttctagtatctgttgaaaattactcacacattcctttccctgtagaaaaaaactaccgctagaattttgtctttcctatttttgttctttcattacattatcttgacgttatagattttagaaaatcttatattggttttgagatcatacaaaaaaatgaaacaataagatgtaaatatattctgaatgtaaacaagtacatgattatttttgcagtttgttttagaacaccagtgtatattgtaattatgttttaaaatctattttttcagatatctttcagtttaaaaagatctaaataatgataattgcttaatttgtgcctgccattttcttttttccatttatacaagggaaaagtcaaatattccaaactactccacactggaatttagagtattagctcagtttttaatcatttcccatttctttgaaatggataataaaattaaatcatcacctgatttcaatttgttcctttgttcagtaacaatgtttttattaaagagatattttgtctcagaagatttccttgggaaaataaggagaatcctgtaattccattcattcaaaagactttcgcatgctattctaattcctgaaaagtggccctatgtttttatttagcaagtgggaaaaagtttaattacttgatgtgtggtatcattttgataagggatagtccttttcacattgctgaaaaaataaaagcatcatatgtaatcattttattgagtgaaattaaatgttaaaagttcagcatttttgcatgttaatattgaacctggtacatttctggaaataccacatttatttttgctattaagactggagacttttttcatgtaagttattttcatttaaaaattttaaaatgaggtgaaatatatttccattggggactgaggaaaagataatattctatacttgattcccacctttaaaattctaaagaacatgacaaccttatacatcttagaacagggtcatttataagtttgcttccctatcttcctactggaggaaacaggtttgattatttattacatctttttaatatgaacattttcttttttttaaaatttttaatgaacgttctttcaatcaaactcttaatgttctctagactataaacgtcattaggttttataagttctcctttggactttgctgtgtgtttttacaaataagtaccttaaaattatacactttctaaaatccattcactctttgcatagatcacggaggctactgatttctgagacgataaatatctcaaagaaggcaaagaccgtcactctgagcctttgtgtggcgggactgtggatttttcacagctaatgtcattcagaactgtggacagctcccgttaaggcatgtagttggtgacaatttcccttagtttctaaactaactccaaggctgctttacattgctatatttatcctataaagaatacttagtatatgcacatactcctttagttgattcttcttttcttttcgaacgagttcggccaaataaataaatatcaccctgagttattaggagttactagttctggattttaaaatgggaagtccagccttgttcaggagctaagataatcgtgcacacgctaataagaggatctactacacgaccttcatttgacaatctctaaatatgcttatcaccgaacgaatacttgagcgacaagtaagatcagaaaacgtcttaattttaattctccaaagcggagttttcctgctgacagctttcctgtccttcttcccgagctggaggacgtgaaaaagatttttgaaatagacttgcagtcaaggtcaagaaagggtgccgctctatttcagaaaggggctctgtcaacgccccctctctctgtttcaggaactagaggcttcctgccacgctcctgccctgcctggaagcgcctggctttggtgagacctcacgtcagggactatccaagtgcaaattgcccttcttttgcctgccggccgctgtttctgagtaaacacagcgaggataaccagcgcctataaagaaaaacagactaaacacactccccaggggcgagcgcggcaggaactgctcgggcttgtgaatcgctgtctccggttacccagtcttcttctgagccccagaagcctccttttccctcctggttgagaccacacttgagggagccgcgcgaggaagggtggcttcccgcttcctcacgctctcgtctctgaagtaaaagtttcccttgtacaacttcgcctcctcccaggagggtgaccgtggcctccatccttccctgatctgtccccgaagttcaggaggccaaggaggagagcccgtccgggattcccgggcaacaggagcacatcctccgagcccctcctgggtggaaactacccggaggcgccgagtggagcctgcttagcccgagccgacgccgccggcagcgccaccccccgcccgccctcctagtccccgggacgccccccacccaagggcggggaagcgcgtttcagggcgcgcctgaagggagggtggggcggcgaccgggagccctcacctgaaatcactgtaagggtggataatccagaagcctgcagttttaaccctttcctgctccttttccaccgccttctggctcccaaacatgcggagggagaatttgttgaccccgggctgcagcatggaggtgaactgcctctgcatgaagccgtactgccgccggggcccctcggcgtcttcgaagccccccgccggctcctcgccgccgccgccgccgccgccaccgccgccaccgccgtccaccttgaagcacacggagttgccgtgctccttcgcgccggccccgccgccccccggcggggtgcccaggcgcttctcggccgcggccggccccgcgcccgtcgcggacgccttggcggggaagacgctgttgccatcgtcccggctgttagacgaagagttgggcttgccgcctccttccatgcccggaggacgcggccggcgacgg

SEQ ID NO: 222 - DNA, 45204 bp, Homo sapiens
  source 1..45204: mol_type = genomic DNA
ttataaaagcttgtttttctttattagaatacttttttcaattctgatttgtcacaatttagattctttttctaagaataagcagaaatttacaaaatttaatttttatttatacattcatccgttcaatacacatttcaagaaagctgtattgcaccctttcagtggtagttacaggacaaagaaacaaaataatccaagagagagaccaacaaatgtatatttataacacagagtaataaacacaaataaatgtggagttatttaagcatgtaagatggtacatgctctaccaggtatgggggcttctctaagacacaagatcagattaaagtcttgaaagataatctggggttagtcaagcaggtagaagtgtgaagagcactttctgagcggaatctccatgtgccaagtctagttcaagagactggatagagattagcaatttggagaatgcaatattaagaaatggcaaaggtgagcctacagagattccaaagttgcatagtgaggtttgtgtttgagaaagtggactcaggcagccacgcaaaagagggattaatagaaaaggagactgaggtaggaaaatcaaggcattagtgttgcagcaggtgtgggcagagttggggaggcaatgggatggattcatgagctattaaaaaggtcaaaggagcagggattcatgacccataagtattaattaatacagaagaagaaaatatcagaatgagttctaaattagggcctgagcagctagatgttgggataataacaaaaagactgcaaaaggagaagatttacactttggcaaaaaatgtatatgaaagtatctgggaattttatgccatcattaaatctacttattatgctgaaaatccttgttagctggaaagactaagagaattccccaaggtgcctaatatataaacttggagtagttttcctacttcaacttttatgcggcttattatttgcagtcaatttatatttggtcaatattagttaattcatttatcatctctgtaagattggttaatggaagcagattaaaatccaacagtggtaattttctggaagtcctccagagagactacaaaaagccaaaagtcaactttaatttttgagtacttttcctatttaaggttactgagataaattgtctttgctagaaaaaaataaacagtattgccaattaaaaactccatttactatagaaatattcctgattattttacctttgggaagcaatgcttgttgcttgaaaattgtatgagcctcaatggttagtggtggtaaaatggaagaatgcatactgcagatgggttacacatttgtttgtgttctatattccaagtcacaaatacactgctttgaattgtatttagtcaaacagcagatttgactaatatttccctgaattcaaatagcttagattaattaagctaactgattggttatctaccattatatagatattacccaagtaatgttgtcaaaataataattaattaaactaaaataaatgtatggccctgagaccagaataaaatgaaaaccaagaataaaatgaagtttgccattaccgggatgtattcaagttcagcaaacttatatgtgtagttaagatgctttacaacaaaatattgcattttgttatagcaacaaagtattgagcagcttccaagtcactaccttatgtgtattattcatactagtaatattggtaaacattagtgatacaattttcactaccaaaattttattatatttttcttagccaatacatggagcaaatttttataaagtatttcttgtcaaatcattgaattcctcctccccaacctttaaattccctagtcgccaagaatcttgggttccacaccaccactctttgcttctgttcttaaagttgttgccctttgagcagtgggacacttcatggtcatttatgttatctagtatcttgtggtatgattttagtattcattcaagcattgacaacttttcatgttgattcagattttataagatttgattacagtgagtttataaaatatttcagttatatatgcaatagaaacgaagtatcctattttggaagataagtctaaggcattcacagcaataaaaaagaagtgctttagtatttctggacttcagtcaagggaattattattgtaaagcactaataatgcaggtttagatatttaaccagccatagataccaggaagccaggtgttaaatcaaagaaccaggaaaccatgagccacaaaagcatcagtgtagcagtgttttaagtattacgactatatggacctgcaccctaaaacataaacaatggtgtaccttatgaagttaaaaaccctatttaagactaagaagcactttagcctggtggggaaagcagtggttatgagtggaataaagactggaaaatttgcttttgtagtgcagagctttagagcaagcacagttttatttatttgccttaaaccaatatttccggataaaaggtatatttttcttgtggagattgtagaataactatcattagcaaaggcagaaagtattcatttcaacttagtaaagacatattttttcactatcacagaaagatgacctttacataaaaattgttacatatacttccatagatactaatagtaagtatgatttttttttaaaaaataactttctaagacaaatggcaaaggctttctttttcatgaattctttggttataaacaggttttgagtgatttttgttctatgaagtattaagtgattctgctgatatctgttctgtgtgtcctttgaagaccagaatataattaattttattctggtctaacatatttattctgatttacattgcttttatgtaacataattacagaatgaaaatatacctttagatctgacatatatcgttgatgaagctcctgctgagcatgttgcataagcttttcatccttttaaaactaaaaactcagaggctcttaacaggaaggataaacaaagctgaaatacgaactctgtatatcttccaatgattctcgacatgatgttttgtattcactggcccagagactcctgagttaaataaagcataatcaaatataattagtatgttctggttattttatagtaacttactatcactttagcaaagcaaaaaatactgggaagtgagggatccaatctactgccaaaacagagctcctactctaatgttgatgaactaaaaattttgaatctaatcagcaaagaaagttagcttatatgcataagtttatacccccaaatatatgggaataaatgaaactaaaataacagaaaatccagaaaattttagaggaaaacaaataaagctacatgaaaaattgtaaaagaaactagtccgtggtgataaaataaaatatgtagccagtgcaaaagatttacttctagattagttgctatgtgccctctggtggaaaatgatttatttttgtataactatactgtatattttcccctataatagtgttaacaagcatatttgagcacatcataaatgaccagatcttttatggaactaaaaaaaagtaactgattgatagatagcctatgtatattgaatttgaccttttatttggaatatcattcagaagtaacttacattttttctatgcctggggacattattttctataccattgctatcatctgatttcctgcacagaaaacaaaaaagaaaattactaaatgcttatattatataaaattaagtcagtacatcactgatatggctatcaggttaaaatgtaaaatgtcaatacggacagaattctttcttcctaaaaatgttttacttacaatgttgaatttattttatggcattgcttgaagaggagctgttaccacaaatgatagtgacaaaggcttgttgattttatgcacagggagaattgcttctccccaagcatgagtgaggacttgggcgtaaagaccataacttatgtgtggttttggaaacatgcaaggtaatagccaattaggaggtcagccaacatgtgtgatattggtgctatacatttgtatgcttattacactgaaatagaggttaaaaatggttctttttccacccaaagtttatcagagcaggactacaaatgtgggcctcagattctaaagattgacggaaactaaataaccagtatgcataatgaataccttgcccttcaaggtcttgggggcaggcgtcaattatcaaatcataatgcatattataagacagtgttacttacaattaactgataattaatattttctaaaaaaaaagaaatcccacgagtgcttgtttttcttttgtgtgtactcttcaaaagcagaataatggccactaagaaaacacctcagcaactattgcaagaaatggtttgagggacatcaagaagctcattgttctgaatgatttcaagtgcccttgatatttgtatacaatctaaagatagtgaaataacctgaagaaaaactaaacaccttcagtgatccttatggtgctatacaagatgagcaaaatgatgtacattgatccaattttcagaaaaataattcatcttttacactatatattgaatccattttacattgttcagaagtgatggtccattccacactgttctggtaccatcctttcagagtgtgttttaaatcagaatgcaacttccaaatgtgagctcagaagaatggttagagacagtgggaggcagagctcggagaatagaggaatccgagcaaggttctgttttcaaatatgtcaatgactgtcacgtttgttatatgatgctaagaacaagaaaaacgccaatacgtggaaataggaaagattaaaagttcaaatcaacataaataagatatctatgttctccagaaagagaagggattctcttgggagagatacaattcccttccaactatgggagtctatgattctaagacaacattgcttttctctatctggtgttataggatttctgatgtagttattttgtgcccttaacttggaagctcatatcatattggtttattttagcagcctatgtgaatggagtcaacatgattatctgaataatgtctacaaacatctaaatgacaactgtctgctccactcctgctatccatgcctgtaacactcactccatagagctcctgttggctgataaactctaagtgccattttgtgttagttatagttgctcaggccttccacttctcaggtttcttgcagcaactttaatctagcctcgttttcctggactccagcccttggctctattgttcaggctttaatcccagtcttggacacctctgtcactggcctccatactcagttctctggcttcgaggaattcggaactcccatctttgccaaactaaattacatccctggtgattttatttccagacctcctcatgcttaactctaaacaaaggctgtgtaagagaacctgtggcacaatttgtgttctctgaataataataactaatagaattctaggccagtgattttcaacagacagaggatcaaaaccatttgtagatgttttcaagaaataacagatgccatagccccaacccaagaggttctgatccaggagattcagcaaggtctgagcaactgtatttttttaaagaggctcttaagtgatcaaaaattgccaggcttgagaactattgctttaaaaataataatattaaatacttcctgatggttactgcacaccttctgtgcaccataacctatgctatgcatttacacatatataatattcattccatccaacaacctcatatggtgagtactattattaaatccattttgtagagaagaaagctgaagtacagagaagtgcaggtagtaagtgatgaagaagaattctcacgcaggtaggcagacttggaaagccactttccaccaccacgtggacatatacagaaaatactcctctgccttttctccccctaactgcaaacatttcattcaattttatgtttccctgtattttacccaagtgaaaattaatctgtaaaaaataatacttacagctgttcaatctgctcaaattctttcccctcatctgtgtaacaaaagaagaatttgactgtgaagttggtttgtcacttttatggaacatatatgctcaattaaacctccttcctaagtaagtaagtactatgctgtttctcctgtttggaatgaaggagagacatgctaccttaaacacctacacctcctttatctgcactacagaccttatctgcatttctgatcaaacatagtttagtggcctggtattttcaaaaacatgactgcttagtttgtcattatttaaatcattaaaaatttagtataaaatcaggaaagaatacaggacgtaaggtcaattttctagaggattactgctttatcaacctgtaacccatcaggcacaggccgcaaaaataggacatgacaggatggtctctctttaatgagaactctggaatggttaataaaatatttttttaaatgataatctaagtgaaagaaaaattgtttcttttagactttttatattaagctatcatagatttttctaatattccagtgccagaatacatatcacctaattggtacttaggtaccagtagcaccaaaaaaaaaaaaaaaaaaaaaaagaggggggtggtgggggaagagaaagaaaaaaggcatttttaatactaagttttttcaggaattgaaacaggaagaccatgggtatatgtttccagctcactgtcaccattgttgtaaacctaaatactgctccaaataagaaaatgaagattttccccaaaaatcctaaagtcattgcaatgtatcaaatcataatccatatcataagtaaatgatacttataattaactgataatactttctaaaaaaaacaaaaaacaaaaaaaagaaatcccacctgagtgcttctttttcttttgtgtgtacttttcacaaagcagaatggtggccactaaaagaatcacctcagccactattacaagaaatggtttgaggggcaccaaatagctcagcaccacaagctcaatgtgttcttcactctcgcctaattggaatagtgcacggcaccagtaagattccccatcttcctccaaaagttgtgttatcttcagctttgtttcgttagcatatgttccattgatcacatatttattcatttgaacaccaacaggaacctaatatgaggagacattaaaatccattcctatcatagcacataaaagatacatgacatagtttttcagtgaaagctataagataatgccaacaatattgcttactagagaaaggcatattaaagtttgtgagaggttatctataacagacttaagtcttatcagagtttgatctcccagggagcaaacaaagaaaaaatatatacattgctataaggatttagcagtgaatgtttaaaactacaaagaagcaaataggtcatcatgaataaatattatagaagaattaaaaacagaaaaatcccaatcatctgagtctcacattcctatccttgcctagtgctttaaagtactttttccttcacaagcacaggcacatattcaaacaactaccaccccggaagctactatttctgatcatttctataaaggaaaatcgctcactcagacaatgtgatttccccaggctagaaatgaagatgaaactctcaggcttttggagctgatgtagatagaatggaggggaccctctgtgagcctgggatccgaagtgaactgcacaccttctgtcttttcatatctgaatttctttctcactcagataagctggcttctaagatttgctgggttttccacagcctcacaaggtgccatattaagctatttggggctgttttatttaatctatttaaattaaattttattcccaagccatttgatgcttttcctgctccatcactcaaccgtgctattcaataaatgctaatctgcatacaaatattctcagagcttatccaaggaataattatctgtgagtatattattcgtgcaaaaaaaattacagcaacctggcaccatgtgcacaacactgcctggaatgtttggtacagattggtcagagctaatcaatcaaagtaccatatttttaataagtacccagctgattctgatgcacatggttggtctacattttgaaaaggcacttgtgctcaagttttgacctgcatcctattccccaaacttttctcacatcctaataagactcatgcttagagtcaaattaagaggataatgactagtatagcaatggacaaaagcactggtacgtctaaaacgacattttcaacatctgatataattagatgaaggctaatgtttttcacatattgttgtaccacatacacatcaataaataaagctgtgtatttcaaataccatagttgacatttgtttttacaaaattacactttttaaaaaaaaattacatatacacaatgactgcctttcctcatcatccatcagaagacataaaggagtaggaatggcttcagtctgcatctatgggatttggttggaactatttcattgaaaaactaaacctgttagcacagaataagtcacactcccttctgaatcatctgtcatccttcaatagtctataataacaccaattttgcctaagaaggaatttaatatttcattgtaacatctacactgtctcacatgttccttctacaattatagcttgcctttaacgggactttaattgtaatgcttcttagtgccagggcaaaggaagggtgtctcttaaaggacaatgtcctaaattttcctgccattagaggctatttggggagaagaaaggaaaccagaaattatttataaaatactcatgtttttcttaatatcagctctttgaatagcgatttctctcagtaaaaaaggaattaaaagtatttggcttctctcaggtagcttgaaaaggccaatgacactttctgatagaacctaagatgtaagattaagttacaaagttttcattattttctcaaatagtgccactattttgcattctatcacagatgtttcaggagacagaagcccaaaaagatgtctagcattttttctagttactttcatggaatgatttttaaaaagaatattttctaatggggttatttctaaactaggcaactacacacaaaatgtaatttcttttcaaagaatgtaattaaattgttaaacctaaaaaacaaactaccagctaatgaaacgttaagagtatcttcatatgtataacgtaaacatgccaaaaaccatcaaatgacaactctgtttgtcactgctctttctttatgaacataagctaaacaacaagataacaaaagtataaatcatcttaggaatgctgagtctgttacaatcttgttattttttaaataaatgttttctgttgttgttgttttcttcaaatcaaggaactatcttacctttacactcccattactactgtaccaggtccaatttaaaggaaaacaattttgacatttacatgtcaagacagtagaatcccctacgtaagagatcaatggcttgtttttcccatgaagttcagggactgagaataaaatagagaaatgtatgttactgaaagagtttaggtaaaggaaatgtattaaatgtgcaaatattgtctcctttcattttttcattacattattttaagtactttcagttatatatcaatgaaactaatttatagtagttagggtgtagttagtagtaataataatagtagatagattcgatataattgtctccaatgtatagaaatggaaggtcttctattattgagcctaacaacaaaagtattgttcctttttggataagttaaatgttttgggtaagaaagaggcttcatgttttcaaacccctgttctttcttcccacctactaagttaccttagagtaattattttcttcaaagttttaacctcaggtagcatttgagtgagcagataaaatttccaggataggaaatctttagttgatactaatttatgaaaagccagcaaagagttagagaaggtgggaacaaggaacaaaggaaaattaacagaaagagaacagcgtaagaaagaaaataagatttaaaaattctttcatgtggttttgtaaaatatatatatatatacactaatatccattatgataaatttcctagtcaaggaagtttgaagtagattccattagaaacagaatacaaatgagcactgaatttagaaaaaaaataagttttaaggatgtaataacttggtaaagaatattaaaagataagagcataaacagtacaataaaaagcctacatggtgcaatcagttccttctgattgacctttaaagatgtattatagaaggtacacttacactgaagatgtagactcatcaactaagattattttgttaatttttttcttttacttttttcaattttagcaggttttttgcttcttttggttttgtgtgtgtgtgcgcacatgcgtgtgtttgtctgtttacttttttcatttatatgtttagtttgccagtagggaaagaatggatgaaatcatgtcaactaaagacctgcagataagcagagattggagcttggctaaaatagggattctttgctgaagccacaagtttccctacaacctgagaggaagagcagccacacttcctgagttccatctgaagaggcacaagatgcactagtgcattactagggcaatgacctcaacagccctgttaggctcaccttaaaacaaacactgttttggagtgcaggctttgcattagacactcagtaattaaggacacagtttccgctttcccaggttgtttatctctcagatatcctatttctcaatctctacatgtttctttctggcaattgagtcatgctttagcatgaaaatatgtgttgaaataggttcaaaataccaaaatttacccacaggctaagaataaaatgtggaagaaaggtaattcttggggaaaaacctggcagaatatacactgcttttcagtattccttgaagagctacctgcttgggaagcataatggaagctgcgaggcgcttttcaagaaagttgagtattctgagatttgatgaggaacacatgactatgttattaaaccatcccaactaaatattaagatcaggctgtaaattgcaggtagctgacaatgactgagtgacaacatggaaaagctgaaaccaaaattctgttttcttgccatctcttcagttttcttgattatcccctagactaatgactaaaataccataaaccatgcttttgttctgctatatatggctaataacagcagtgtggatttaaattataaaatgcactatgttcagggaacatgacatttgtttgaactattctggggttcagggccacagcttatatttggaaatatttactaatataaggacagtgagacagtattctaatgtgccctgtcgaccttttaagactttgcataaagtaggatgcatacgagtgctacggttggaataaaccaggtttgaaggtggtgaaattgctgattcaggctagtttctaggaagatggggtttggatatacccagtgaaagtaacagctctctggagttgtaaaattggagactatatttgtatattcatgaactagaacaaattggcctaaatgtcatattggttcaaagacttttaggtaccactaaattaggaaaaaagattactccatgtagtaaaagaatgctaactatacttcaacactgggatccagggctgaagtcctagctgattctattatgctacctttccatactttatatttttagatacttccaggggaagacagatagttgagctttgacaggcttcactacatttggtactatcaaaatctcatcatgacttccaaaaagttcttgttctttaccaattaaatttctgcatactttctactaagagattttaacactgataaatattatggaagctttcagcaaccactcagaatatttgatccactactgagaaacactatagaccatcactcatctttctctttctcgggtggcaagtaatcagcaacttattagcagtcacaaacttccagtgtacacttttgctgtctcctctgtcctggcatcaagagcgaaacacataaagtcagcaggtttttgtgcattgaactaatcagtaatcttgagggccttttacaactttgtagtagtaaatcaaccagcacccataaagacagcagcagggactttgctgatgaattgttctgaagactcaggctcatgcactataggtggctcatgtagtcaatggcagaaaaatttatctttggttcaatttaaaatagagaataaaacagtcttttcatctacatgcagttgtaagtcttctaagaaaagataattattcttcttaggaaaaaccattaagtaaaccatatggagaaataatataataggacatttataaaaatacacaccattttataagcctttcagacctattaaataactataatatccataatgtacagatgtctttaaatactactcaagtaaaaattatttctgtaagcaatattcaatttagatgaattatagggaatttttattttaccaaggaagatttaaaaggacccaacttattaattttataaatatcttcaagatataatacatacttaaaagttacattaatgttaaaggggcattaaaaacaaattagctaacctaaactgcttcaagacaactagaaaagaaaaaaaagtaaatgttcagtgattctttgctttccttaaagccttgatttaaatcctaggccttgggtcagcgctgctgacaccagccaaaatcagcttagttatctcaaaacagttggagaatcaagaggccttccgtgtgaatacttgcaattcaatgtattggtatgttgaaaagtaaaatgcttgttaatcttcacattagacacaagaatggtcacttccacataataatttaagtaattatcaaaactaatgagaaaaatgtgttatcttcaatattgaaagcaggtatgactagtatatatttccagagcacaatgtcttagaaaaaaaaagaaaaaagtgtttaaagttgaatatcttgggagcactttaagtcacaagattctgtgagcatttcctcagaatctgtaggccttctttacatattttttaaaaactcaataaaacatgttcactgaaattttgtgtgtttagtattattttttgctcattgggaagaaaaagagaaagggaggaaaaaaggaaggaaggaggcaggaagggaaggaaggaaatgaactcaaaaggtgggagggaagaaaggacagaaaaagggaaaggaaaagagagattaaggaaagaggaggggaagggcagatggggcaggggagggaaaaatgaaatgcataaggaaaaggaaactgaaaggaaatgtatatggtgttatctagtccttcaccaagttaaaggcaaatggagggaaaaaagttaagaaagaatatacatgactaaaataatcaaagaatgatactagtttctgcttttggagagaccaagatatataaatacaagaatttattatattcaccacattggaacaattacaaagacataaaaataaaatgactctgtgagtgcagaagggatgcaatgagggacacaggagtgaaccattagatcatggcaatggtgaagcaagccattctgctattgatggagccttgagaatagcatccacattctgtcacagcagacagtcgggctttaggagttttaggaaaagttacaacaattttcatgtttcctggggaattaatgcaaagcagagtccgacgtagttaatatggcgacagattgcatttcccaaataccagcacgataatatggttcactaatcaccacaaaatactgggtttttcataatgataattatctaactcaaataactagtctttattatgagattgagaccttcttgagttttggtttaatgatggtaacagtaaaatattttaattcgtttgtttccaagcaaaagaaatgtggatgatattctgtggcttgtatatatctttaaacctccttacttggtgagataaaaagtaggcaaccgtttgtgcatctccatattatttttaagttttatggatcctaaaatcccatgtcctggagctatggatatagaacatcaacccacactctcagaggctgggaccacaataacttagaaacgtggaggactattataagagctatgaatttagagagataaataaagaaattcaggcaactgatataattcactaataatgtggtaggctggccttttgaactaaaacatgtgctttaaattgaggaatagaagcaggaaggaagtggacttgggggatacaagaccattttcaaggctgcctcttgtggctctggaaagcatatgactttctttcagctacattatgtttattattgtaaaaataattttaaaattacaggattgagaaatctaagaacataatgctgaagttattaactattcctcaagttattaatactgacctttgaaattaaatgttcccctttgttccttttcctctcgaaagaaacaagaataacttcccatttgtttgctattaatgatggtgaacctaaagataattcaagttattaatataggcttagttctcaaaaccttaatgaaaatgaaaagacttagccattaataaaaatttaaaaagagaaataattctgtaaatatgcaaattagaatattagcataacattcaagtggctgcagaggaaagaatgctcagtcagcaaaaatatttagaattaagctacttttggtgagcaaggtaggttaaaatttgtatactcacctgtattgggtatacaaggtgcttcctgttgcactgacaagataattattctcaagttgttcaccatcttttttccaagtcacatttactgcattcaaatccccagatgttgtgaactggcatgtgagatttacattagaaggcctttctaaagtgatatttttttctactggcatactagaatgttctattagcacaaaagaggacaaaatgtgaaagttatattcagaggaatctaacacataaaaccttttatattattaacagcagtgtttcattgacaatttcttaatgtaacattcatttgaagaattattcctctatcaacatagttggttccctttcttattcccttttatatgcacacctaaagaaaagttttgattcaacattaacacaattaaaaaaaacctaaagctgtgatagttatctccttaagctctatactgagcagaatatagggtagagagtaccctataacatgtgccgtatgctctgacagtgtaaaaacagcacaactgtaaatacaaacacacactcatgggtgagaatggaatgcctgtttcaataattttgagtaatcatgttgttagtagttattaagttttatggatctaataactactagagaatgttttgtgtgtaacatggatttgagtgatatattatattctaaccattcctagtcttcttcagaacctgtaaggactggatatagacataggtacaagacagagaatttaaataagcatccagtagttctgaattttgactgaatttcaatatcagtatgaattcatgaggtgtttatccttctttttgactttcaaaatagatatttattttggattgattgattatcataagaacacttaacattagaccttccctcttagcaaattttttaaacttgtacctaaaaagtagtctgaaaggttctcaattactcttcccatctacaggtgggaagagaaggagctaacccttagagaagctttagggaagttgaggtgtttatcttgaaaacaatacacacacacacaccacacacacacacacagacacacacacacacacacacacacactgaaggggtccagaatatgcctggatagcatacaaattattttgagcagaaggcatttgagttcctaaaatagctactctgactaaaagcagagcctttcaaaggaactccaaaaaacctccattgtcataaatcccctccctaggagcaatagggagaatggagtcatcactgaacatgagaaatcttcacaccacacctaaacagacactgtcacaaaactatatcttccacctgttacctaaagggctcatttatctttcctaaaactcatttcgtttttccataagctgcctttctctcctcctctccttaccctactaagatggtgtataagcccccacttttaactggccctttgagctacatgttttggtaacttttgtccatatgttattaaatacgctttttgttttgctaatctatcttttgtcagtttaattcgcggagcctgaaattgtagagaattgcagagaaaaagttcctccctgacagtttggcaaggaatatggaatggttaggactccccacccttccactccaaccccatttctaaagcctgagatttcaggacctctgacccagcaggtaagtacaagctttttttttttttacaccagtatcccagaaatctgggatttctgggatactggtgtaaaaaaaaaaagggtgcactagagcaagagcagtaagagcctctacttgtcttttctttcttcagtttaaccctcaagttcccaaccactaactatccaacaatacacacatacatacacacgcgcccacgcgcacacacacacacttagggaaaacacaaaaaaactaactttaattttgaacagtggcaaataaagaaaaaatattaagcatgtaccttgtttgtcctacactaactgtatcactggctaaccaaacagtagagaaaataaacgttctctttatagaaaaattccagcaaatgaataaaaaagaaatcatacaaatataccataatgatgctgcaacccctagtgaatcatggatctaggcattttgcatcaactgctgcaataatttcaaaaacagaattatgtctctcttgaggaagaataccccactacctaggatatagtcttgttaaaaaaaggtgctggaggaggttcttgaaactggttaagtctctggatccaattcccagtttacaggaaacatggattatagaagaacacattaacctacatttcatgaaagtaatcaacaaaatccagattctgggaaaattctacaaataaatgatctggttttttctttttctttctttcttttttttttttttgagatggagcctcgttgcccaggctggagtacaatggtgtcgtctcagctcactgcaacctccgcctcccggattcaagcgattctcctgcctcagcctcccaagtagctgggattacaggcgcctgccaccatgcctggctaatttttttgtatttttagcagagatggggtttcaccatgttggccaggctagtctcaaactcctgacctcaggcgatctgcctgccttggactcccaaagtgatgagccaccgcacctggcctggttttttcaatagacaaattttaaaagggagagagatgtctttgtatcggacgtcaggtgctatgtttggggcacctgaagattataagatactcaaaaaatactattaaaagaaaagcaaaactgaactgtaatatttagggatgcatacctgggtaataaagcaatacagaaaagcaagaaagtgactgcataaaaatcagaatagtggtaattactcttaaggggaagagaaggagttgtgtttggaagacggtagtatatcatataaacaaatttctcaagctcttctcattctcaataatggtatagtatgatgaaatgtagaatgcagagccaaaatgtagaaagaaaaataatacaactcaaataaaatggtcaggtgcaatggttcatgcctgtgatcccagtaatttgggagactgaggtgtgtgggattgcttgagcacaggcattccagaccagcctggccaacatggtgagacctcatctccacaaaaaaaaagaaaaaattagccaggcttggtagtgcatgcctgtggtcccatctagtctcaggtagaggtgggaagatctcttgagcccgagagttgaggctgcagtgagctaaggtggcactactgcacgccaggcaaggtgataaagcagggccctgtctcaggcaaaaaaaaaaaaaaaaaaaaaaaaaaaattctatcacttttaattacatttgaaactttacgaaatgcttccataagcaaggaccagatgcaaggtttgcagatagtgaagtacagctcgtgcaaagtgctttgtgagcacatgcttgaaataactgcttgtaaaattgcaaaattgctgaattgaatttaatgctcaaaaagaaaaataatatttgatgtctctagaatacatatattgccagagactaccttattccttgcagttccctttactgtgctctatttcactatcctagtatattttaaacattttgctagccacaccaaattattccaactaccttttaaatgttggtgcccatcaggattttgctctctggtctctttacttctcaatttggcacttctttgttggattcaactattaactctaatgctctttacttgcaaaattagaacctccactgaagtcgtttttttattttacagctccaggtgtctacggagcatctaaatctggatatcccatgagaacttcaaactcaaaatatccaagagatccattaatattcccttgtgctgacctataacactgaatcacatgcagtagtatttagttgattctaccgctaaaatgtcaaacaaatttgcccagttttatccaaccctcctattattggccttcattatctttcaccaagaccaggtaaattatctaatttctcttggccagcttctcttgctccaaccaaaggacaactttggttggagcaatttaagcaaaactcaaattgtttaactgccttgattctataccttgcatgtgcaaatcaaagtatctttgtattagacatcagtttccttatttgtaaggtgggacaataatattccatgagattgtaaaaagttctatcataagaaacgtcaacagtaatataatatagcaattaataaatgcccacttacttcttctcaccattatctcactggggaatattataaaaactatcatatatggtgctaagggttatatgttgattaaataatttaatcttcacaacagctttatgaggtaagtatcactgctacaattccaactttagagatgaggcaaagagaggctattttgtctaagattacacatcaagacaaaggcaacactgaatctcagatttaggtatgcctgagtccagactgtgataaccaacagaatataccaactctcaaacatattaaattctcattacaatggaattaacttcatcaccttcaaactgttgaaacaagattttaaataaaagaaaatattaatagaagattaaagaaatgtacagtgtagctatataccaatatgaatgcgatgataaaatgaacagtgcaatcaaaatattttaaaaatacacattttcaactaaacatagttttacataacttaaagtgcaacacagtttttcttaatggtaggccatcctccaagccctaatcgttgtctcactgtttcctataatactttgcaggtgcttctgcagtttgctgtgcttctgcagtttgctttccttcctgtcaagaaatcacagcatcaaaaacatgcaaaaagctctacctttttacatattttgtggttagccaacaaactaatgtgagctcagtcaacgatgtttcaacttccttaatactgcacaactgcaatgcatttttgctgctttagagtgctgcaaaaacatctatgacatctgcatttctaaaacgataacaatttgttgtttttgaaacgtattttcaagactgttcttaaaaccatatagtaatttatacctgtctaaataatttcttattttcataggtaacatttttaaagtatatgggcctttcaacaatttgcagtcttcagagaaatgacatttagattttcttgggtctattcaggacccaatcttgtaaaccatttcactagaaataaaagtctgctttgttctttattaagaaaaagaaaatatggaagaagccaattaaaatttattgcataggatagtgtttccaaacatgctttaaagatagaaacccttactaaacacagttaagtgaactgtgacatatacgacggattcgatgggacaactctgacagaagccaagatagaaaatacagagccctatcagcctgacttttcattattcataatgaggtaggaggtggaatgtgactctggaccagattgaagactgacagaaacaaggaagaggcaacgaaagatcctctccgtaagacacacccaccagcaccatgacagtttaccattgccatggctacacccagaagttaccatccctttccatggcaatgacccagaagttaccttctgttttctagaaatttctgaataccttgtcccttaatttgcacataattaaaagtagtataaacatggctgcagaactggccctgagctgctactcttgacacactgcccaggggtacccctgctctgaaggagaagtcacagagctgtaacaaccctgcctcaataaagctgatttttctaccaccagctcactcttgaattctttcctgagccaaccttctcgggctaaaccccaatgttcggattcacctgccctgtaataatttcaccataaaagtcaataaagcttcatgatgcaacccaaaatgtctattaaacatccagaatccttacagaaacagaaggccacactaacatgaggccaacacccctatataaaaatgatacaatggatcttatttttatcattaatgttgtgcgtcttaaacatatggagttaacttatgaataagaataaaattctcaaagtttatatccaaaatttataaaacataatactaatcccttgattcttgtaatttcacttctctcccaaataagtctcatatggattgaagaatcatgatggtttattaagtgatcctatcaacaagttatttacatgccatctgattagtgccacaccaatgtgatacagcctaaaacacacgtgcttcctgaatcccataaacttaaaatgtgaaatcaccaatgtgcacagagaaacctgaaattatataaacccaacttgagtaaaatgtagtacatataccttgatatacttttttatatgtatataaaatctccaagtaatccctggagactccctcaagacctatgaactatgtggctggtgttatatgagctgagcctattttcaaacttttagaattttttttacacagacatcctcaaaagaaagagaaataccagaaaacatgaatggcttctacacaaatgaagccaggttttccaaaataattcatcaaagatttggcaatattttggaaaatatgttaaaattatttaagaggagatgctagttgaatttcactaaacaaagctcctatcagtcactgttttcctccacttcatttagtaacagaaattaaggcatgtaatggttatttctctactttctaaactgatttaacatcatttcaaagaaaaacaaaaacaattctgtttgaattccagaattgcatgtctcttgtttcaacaatgcagtatttaatttgagacaataacattgggtaataatccaataattaaatatatttttctacaacatagagaacactgcaactattgtttacatcaattacaggaaaactatagtaaatggttacactgttttagtaaccaaatacatttgttgccactgtttccaaataattaacatgaagttaatccaacactatagtggggaccactgatcatatttttggacaaccagaatccgaacacccttcccatccgtgtaaggtttggtgataggcaaagtactcactcactgcggaaacctaagaacagatatttcttctctctgcccagctgagcactagggtttggccactttaattataaccttctactcatggctgtaaagttagagggagggagttagggacctaggcagaactgaaaattaatcacaatagcaatggcaagtgtctagcagtgattgtgcctcattattctttcactcactcatttaacacttatttaccgaacacctaccatgtgcttttcatttatccactcgttcaacaattttactaaaaatatatcacgtgcctttattctaggccctagtatcaagagtccagtgcctgcagaaatatcttaagcagactcttccagtaatccttgctgtctgtcagcctgaggtccttggcattgccagaacttgatttccagttttctcatcaattctgctagccaaaatcctttattcaacaaattatttcctgcttaactggctatagactgtttctgggcttgagatcattaacctaatccatatacacctatcaagatttacactagatacttcatctatgcactccttccattttattaaaattacatagcactgatgtcacttggcagctcacaaatatctagaacatatgataatacttggtccccagaatgaattctgcaaagtggtaatcatagtaccagttcagcacatttgaaagacaatacctgaggttacacaggggacaagatccaggctgaggtagcagtccaggactcagatcagccagtccctggccctgtatgctcccctccatggccagtcctgcccttttgttcttgtagctataaatcacactttagtattttttccatctcttctacatttacaaatcaaaatcatctcaagccataacaacttgcctccaatctttatatctaatttctgccttctctaccttgataaaaagctttcatttattttgaaccattttgcacatatccacttcaatataatggaagaaaggaacagcaaatgacaatgtcatatcatttgattccccagtacaagaaccatttaaattttgaaatggattattctaatggatttcaaaattattttagtagcagaattgtttcagaaataaatcacaggaaaacttaaacagaacccccactacatacacacacacatacacacacacacacacacacacagataactgtataaaactgataaaaagtgttgctacaattagtgaagactggagagggtgtggaaagcattcaagattggcctcttcatcccttcatctcctttccccatcatggttgcatcacatggaacaaaggacttaaaagtgacacatgcacacgtatgttcattgcagcactattcacgacagcaaagacatagaattaacccaaatgcccatcaatgatagactggataaagaaaatgtggtgcatatacacgatggaatactatgcagccacaaaaaggaacaagatcatgtcctttgcagggacatggacgaagctggaagtcattatcctcagcaaactaacacaggaacagaaaaccaaataccgcatgttctcacttataagtgggagctgaacaataagaacacatggacacagggaggggaacaacacacataggggcttgtcgatggagggcaggggtgcagagcattagggaaaagagctaatgcatgctgggcttactgtctaggtgatggattgataggtgcagcaaaccaccatggcacacgtttacctatgtaacaaacctgtacatccggcacatgtaccccagaatttaaaaaataaaatacaataaaagtaactggattccatcaaaggagaggtaaacacaagtctcagcacacaccagatcaagataagggctcataaatacctaatgtaaactgaaagcatggcctgctaccttggtaatgaatttctccaaactgcaggtgtttacaccctgatgccaatccttgatatttagtcttacaatggtttatgtctcatggtatcaacttctaaggtgctaaccatgcagacactcagggagtcagtacatacattttgtacacaccccaagtgactgattgtctcaggtcacatgcctcctttgcagaaagggctcctctaaccttacaacactgctaacaacagactctctctatcacacttcctttatatacttcctagcatttggcactgtccggtttcacctttcatattaatttgtttacttacttatccattgcctttcccactgaaacatacactgtatgacatcgggggaggagggcagaaagggaagtctgccatgttcaccactgtaaacgaggctttcaataaatttttgttgaagtggttgtagctcccggaatacagtacttaaaacatgaatcacttctttagacagataaggcactttcccttagactgaaggttcaagcatattaaaattctgcctcatgatttatatgaggaattctaggtggaaagtactttacgggatatgcaagaaatgcataagaagttcttgtctcacacagttgactcatccattggccaaaacaaatttgtttagtacttttatatgctatatgtgatatagaggggatttaaaattactaatctagcaggggacatataactcaaacacaaatatctacaattaagtttaactacaacagatactgcaaataaaatgagatctaaatcacagacggcaatagtataaaaacattaattttccccaaaataaatctacagagtgggtgaagaatcagtcaaattccaagagtattttttacagaacccaattttaagaaatgcaaccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcataccagttagaatggccatcattaaaaagtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattatcaatcatgcttctataaagatacatgcacacgtatgtttattgtggcactattcacaatagcaaagacttagaaccaacccaaatgtccaacaatgatagactggattaagaaaatgtggcacatatacaccatggaatactatgcagccataaaaaaggatgagttcatgtcctttgtagggacgtggatgaagctggaaaccatcattctcagcaaaccatctcaaggacaaaaaaccaaacaccacacgttctcactcatagatgggaactgaacaatgagaacacatggacacaggaaggggaacatcacacaccggggcccgttgtggggtggggggaggggggagggatagcattaggagatatacctgatgttaaatgacgagttaatgggtgcagcacaccaacatggcacatgtatacatatgtaacaaatctgcacgttgtgcacatgtaccctaaaacttaaagtataattaaaaaaaagaagtgcatgtgaaagaaagtccaagaaagaaaatctgtttttttaaaaagaacagataaaaagatatgtttttaaaaataatactaacatgttaattatgccataaaataccaagaaattaatgaaataaaataggcaaaactttttagactgcaagcaaaaatctattagtgaatcaggaaatcaatttaatagttatcaacagatttgttttttaatggattggagtaaaagagaaattatcagagtataacaagcttattaggtgtaggtgttattcgatgaatattctgtttcatatgtgtgtgaacatgcagttggtgcatcaggttgcaaagtaaaatgtacttcttactttgggaagtactttaataactttgtaaaacaatgtaacagtagagaaacagaacagagtttgggaactgaaatatgattagagtgctatttcaaagctatcaggaaaaggagaactattcagttaagaaagttgagacgctggctaacagtacaaaataataaccataaaattagttccttctcacacacaaaacataaaactatatcataaatgggttaaaaagtgaaaggtggaaaagtatgcaaataataggaggaaatataatgaaacttcttcacaactaaaaaacaccacataaaagtttaaagtttaaagtgggaaaaaatattcgcaacttctataaaaagtaaaaattcagtatccaaaatttatgcctacctcatttaaattaattcaaaaaataaaatataagcctagtacgtgggtcagggaaaggggccaactgtcaagatgttttgaaggccaatctggaagtatatgttaaaataaagatgtgcataatttctaactgagcaactctactttgtggtatttatcctagagaaacattcacaattatgcccagagagatatatgtagggtatcccttgctacatggtttataacaaaaaaatatattagccaactagggtccattaggaaaaaaatgtctaagtaagctggtgtatttatactgtgcatacaaattaaaaaaaaaaaaagctagattcatatgcaatatgactagatctccaaaaactaatgttgaatgacaaaaatcaattttcagaatacatatggactaatagcactaaaactaaagaaaacaaacaatactagtttttatggatgcacacatgcacacacacacatacacagcatgggaaagaaacacattgaacagcgtataccattgtaaaagaggagaagagaagagagacagaaatggtgggtaattcaatgagacttgaaactcatcagtcacattttttatttcacctcctgaagttctatttggatattttttgaacctgctttgtctttttaaaaaacagtataatattcattctcatgtttttgatatttatttctctacctagtattttctataatctgaagctctggaatgtctaatcctactgctccttagctctgttagggactgtgtgcttgttttttatatttttgttttgtgacatgttgagacatgtaacagcagggattatgtcaccaggatggacaatgcattcttccacagagggtttttcattgctttcctgtggaagtactacctgccagggtcatttttgtgttatttctcagctcggaggctcctgtacagtataatgcaggtaatgtaaatttgcaatttaaactgtgttgaggacaggcccacgtctttaaataataacggaaatctttggggatttgcaggtttaaaaaaattatttttattcacattatttttaactggcaggaaacactgggaatcttttggtttaaatgcctaacaaaactttaaaagaaataagccaacttgtcatcttgtgctgtcggctgattttcttccctaaatcaaacctttccctatatttacagcctaggaaggatagttttcttcaggttttcagttccaactctcctccttgcatgaactcaaggccttgttttttatatttttgtagctcttaaaactcaaatatcttggcaacaaacacaggaaacctaacacaatatcagttaacgggtttcatgccctgatcaccaattttgatcggtagaaacttctttacttttgtgtacattgctatatatttaaaagaatgtttactgtattttagatactcgtaggtgtggcaggagggttttcagattttctaatttactctaatgctgaaaataatgtttaatattttcaaaacaactcatttttacttgcagaattaaaatttaacaaaaatacagtaaatacatatcagagaagcaggaacatatgcgcttctctgatatgtgctttattgaagatgggatcttgactccattcttagagagaggaaggatttgaacaccagtaggagggagggaagagacaggtcccacttacagagtgtgaggtcctgtgcctgtgattcagcaccatcatctaactttatggtgagattctttactaaatgttaatcacaagattattaaatcatgtgtattcccaagataaggggatgggaaacatgcaggactctcatttttaatgtatagaacagtggggataattttcaaatggggaaaattttgtaccccagggaatgtttgacaatatctggagacatatccagctgtcataacttagcaggtgtcactcacatctagtgggtaatggctaggaatggtgttaaacaacctacaattctgcaaacaacctcctataaccaagaatcatccagccccaaacatcaatacttctgttaatataaacaaaaacaaaaaaaactgatattaaaaaaacaaaagttgatcgcagccactgccacttgtgttgctatgggtagatccctcttccatctttactttctctgactctctatgaatgttaggcctcagtttttttctctgtgcatcaacagtctacatatcaagtttgatgagtacctctgaaaaaatatcctaacacttgcagcattggagtcatgctagaatcttttctgcaataaagtattttcacttcttttcttcttctcaatcttctcaatcacctgcccctagaatctgagtggtcctaacctagacctcttgctggccgagatttagacaatgtggttgtttttccttatcttgactaatcttcccgaatcttacattgtgccttaatttgcacatctgcacctctaatgtctgcctatattatctccttggctcacaaggaccttgtgggagagctgctcacatctcaacatgtaaataaaatgtgcctttgggtcaacacaggagaggtgattccaacgttaacaagttggtcaaggaaactgtcagctgtttatttttatttcaatctcttctgttaaactataacacactgattgagcaactaaacactaatatgcagagaggaaaaaaacaaaaaaaatatattgtggtaatacaaacaatacaatgaattccaaatactatggacattggaaaattaagtacagtgatataaaaatagtccattaccaaaagatctgttttaaaacctctgagagcagaaaaaatacttttagtttcagtcaagtcaattactttcacaaatttatgattaagcaagtgcaatttctttatttctgggggggcaggggagatggactcttgcagtggcacaatctcggctcgctgcaacctccgcctcccaggttcaagtgattctcctgcctcagcctcccaggtagaagggaatacaggtgcccaccaccacacttggctaatttttgtatttttggcagagacggggttttgctatgttggccaggctggtctcgaactcctggcctcaggtgatctgcctgcctcggcctcccaaagtgctgggattgcaggcagcaaatgcaacttctaaagcaatagctttattactaaataagcctagaaatagcaataaacctagaaaatagctttattttcattgtttactacatcatttcaaaactaatgtcattcttctaaaaataaatatacttgatttaataatgctgttaaaagaaacaagtaactgggcattatgcccagaaagaaaggctgcaaagcataatggctaatagcacagactgggcaccaagctgcctgcattgaaaaccataagctccaactcaggaactgtgatcctggtcagttcacttcgcctctttgtgcctctctttcctcacctgcaaattacaaatagtaatagtacccacctcattgagctgttataagaattaagttacttagaaatacaaacatggtacatagtcaacatcatgagtttgttaataattagcaatattttaaaaatattaaataagtaagcttttatgaatcaaaagccatgttttcattctcccaggcacaagaatccatatgttttccagtctcgagaatctttggataagtatgtatgtcaagagccagaccaaaatctttctggtccaaaatttacaattaacgtattgtatttgaatctctctacaagatacattttatcctaacagagagattaacttcgacaatggccagagggaaagagaaaataataagtaacaacatagaaatgttataagtattgtttctagacaacaatgaataatgataaaatcaatattgatacatatcaatgttatgaaaatatgaaaacactccatttacaaatagtaggttaaaaatcttaacagcagtaagaagaaagtctatggttcataaggtaaaaattgataatcaggaattggagttatcttgtcattttcaactaaattagagtccagagacccagtaaaaaagaaaaaaaaaaaaaaaaacacttaggacacaaagcacctgcccggggctaatactgcaagctagctgctgaaatgacctggtataactttaagaccagttttacctagcagcttctgaaacaaaccaccatgactctaagactaatttacccaccaccatcactcaccagtcagaacttgttagctcccaaaaactttgctagtgctaatgagttttcttccaaaacaatatataacatttctctctaataaaacctctaaacttctctttggttttcagtcatactgaagaccattccactctctgtgtaagccctgaactccaattctgttctaccaaataaaacattttgtttagagattcatctcgatatttttattttacattgacactaaaaattataaatatatcttcaaatttaaattctgtagttcagcaaaggtagtttctaagaccaaactttttgatgggaaggcactagagcaacaacctacatggaaatgtaaccattcagtgcccaactctgagatctaatgtttctaaattaatgacaaatctttgtcaaaaacaaatccaaagttaaatgaagacattattattattattattatattattattattattatttgacagagtctcactctgtcccccaggctggagtgcagtggctcaacttcggctcactgaaacctccaactcctgggttcaagtgattctcctgcctcagcctcccaagtagctgggactacaggtgtccacaaccatccccagctaatttttgtatttgtagtagagacagggttttgccatgttggagttccttgcttgcttctccttagcacagtgactcatttgatatcatctttaatttctctggctaaaggttttccaacagatacacaaattctcttcttgacctagagtgatgtaatggatgtaccagcaagaattaatgaaaacataagagtatctgcaaatcaaaattgattctcccttttctcaggtatccattttctggggagccattcttagccttggcatgtctggtatattttcctcctttgtgcgcccccagtaaaacgtcctcaccacattagattcccagctcactactggtatgttttcccaccaggccaggaacagggattaccacttcgcaaagcaaaaagcagtagctttgtttaagaaaaattgcttaaaccctttttttcgaattgcattatttgaaacatgatacatttaccagtcagtgatatgttatgactctccaaggaaaagttatttgccattatttcttctctgagaggtggacttgtaaaaggcgaatctataagagaaagaacacatgattacacactcttatcaagagtaaatgactatctaaaaactactttgaaacagctaaaacactgttgtgaactattaatgaaaaactgtgttttcaggaagctcaaagtcttatatacttcaaagacatttagagatatattaggctattaaatgtgaaaaaaattctgattttttttcttttttaacctaaaaatccctactgacttacatcagatggctttttttaaataacgccttccatttttattctactattatagtttctttacaaaacataaataaactgaagataccaaggaatcagatgagagagccagaaaatggaaagatatgaagaggcagagagagaagatgaaagaagagcgacaggcagaccttaataaagagaattaaaaaaaaaaatagatagcactgggcaccagggaacagagaagataaaatggctgacgggccagtttgggttgctatttgttttctagctacggttaccaagaggcatgccctctaacacctgactttcagtttcctctgcctctgtcacttctctctccttttgaaaactttaattaaagaaacaaggtttctatttccacctctctcactctcttcgaagttactttatttattttatttatttttatttttatttttatttttattttgagatgggagtctcactcagttgcccaggctggagtgcaggggcatggtctcagatctctgcaacctcagcctccccggttcaagcaattctcctgcctcagcctcccgagtagctgggactacaggctcccgccaccacgcccagctaatttttgtgtttttagtagagatggggtttcaccatgttggccaggatggtctcaatctcttaacctcgtgatccgcccgcctcggcctcccgaagtactgggattacaggcatgagccaccacacctggccaacaacatggcctactgttccttttattttagagtaccagaccttaccttccaggaaactactcaaatatatcaaagaagtcagagaagggggaaaaaaagcttattattgtaaacttggctgcattatttaaattaaatcccattcaatttaaatgaaacctgagccatttttattacactttttaaaaataatctgctcagaaagttatttctagtacaagattagatttccagttctttcattttcttatatgtaaaagttagtgatcacttttgttactttagctttagaacattgcttttacaatatcgcctagtaaaataacgtacctagcagaacctaactctccaataggctgtgttccaaaggtttaatcacttctaaaacagctttagaagtttaatgcactttctaaaccaccatggcacatgtatacctacgtaacaaacctgcacattctgcacatgtatctcagaacttataataatttttaaaaaaagaaaaaaagtccttaaataacatattaaatcagactaccctctcacaatgattatataggaaaatatgtcctgagtttctcactaggctatcaagtatacaaaacctttcctccagtcacatctagtattcattcattcattaattcattcactcattcattcatatttgtacccatattctcccattctccctctcctcccatcaccctccttctctgtcttttcaccccttttctctcttcctcttccctctcaccctccccaactctctttctctctctctctctctctctctctctctctctctctcacacacacacacacacacaaacacacatatacacactgcttaaaagaaaggctcccataaatgttattttcctaatgaaaattccttgtttccattcttggggctagcatacttagaggttatattaaagacaaaatatttcaggaagatcaaggcagatgctattcacttatggacaggaagccaggcgggggtggatgagaaggaaaccgctattctactatatcatctgttctgtgaagcctgcaaaacgtaagctttgatatctttgctttcctccccagggataccccactgtacagcagaatacaatcttaagggttcttattatactctttatccctgaaacaagcccataacctttttgagatttccagcatcatttattattatggttcacagtatcagtaacaataagagtgacataaactaaagaaaaaatgctttctgtcattcttattcctattccacttaagtaagtgaatatacacagtatctcatgcacacttggtactgatggagaatatgaagctgggcaaacttggtccttaaagggctatgtggatcataatagtaggggtttgggtccataatttgagattgagagtcattaaaatttcgagcagcacccattaatgcatagtatataactatgcattaatatataactgtatatatagttacagttatagtcagtatataactgactatagccagtatattttatacaaattggcacatgagctagagtatgaagcctgagcctggaggtggaagaagggtgaagataattccaggaagatgagctccaatgctggggctattctcccttactgatcactaggacttgtcatggatgggctcaacagggacctgtgttagaacaaggagagaaaatgagtctaagtttggctttggcagaatctaagctgatgacagttgaaggataggaaaggaaggaaacaccaagtttccagaggtagggaagtctgggtatttccagaatatactagctgttgaggccatttacaattgctggctcacatattaaaaatacaatcagacatccataaaccaaacaccaccagtaccttaacttcatattccctttaaggcactaatcttggtcaagcttcaggttccacggaaaaagtgccaagtgcaaaagaacacgtgtaactgctgtgtgacttttgccttgggaaaagtcccttaaagaggcaatatacagaaatgccttaagtggaaaagcagggcaacctacagaaggtattaggacagtaaaagaagttctttgtttaggcaagatttttttaaccaaaaaagtgagaatgtaaaccttattgctttcagttggaggacagctggcaggaggctgattcagctaacattggggtttaaaggaaattggcaggagactcaggcagatgtggtttgaatacttccctaaaaggattaggctgagtcacaaaaagaagtataaaatggagaggaaggaatttggggtcttaatccaaattctgtcactgactgttacttagggtttccaaacgccatatgcccagctcagtgctttgaaaatatgtctccactgtaaacctcatctgatagggaaaaaaaatgaggatcagaaaagttgtataaatatgagtgatgatgccaagatcataacatgcatttctcaagttatcaaactcaccctttcttaatcattgctggaaaatttccatatagcattcttttacaggtagagacaaaaatatcaacatgaaagagtaacatcaaatagttgctcaagagattaaaagacttttttctctctttgcagggcagttgaggcataagactactgcatcaaagaagtgagtaacatcttaattttcacctgttataattttctgtgaaatagcaaaatggtctctacttaaatgtttttcacatattatattttaaaatgtgttgctagaagggcatataatttattctattaacactttcaagtgaaataaacatgctataattctacttaaaggtattaaggtaacattttcacatatttcattttgaggacttcatttaattgaagtaagttgggaagaaaaataagtaacactagaaaactgcattgggtcttaagatttgcttttttaaatcaggaaataaatgcaactacatctctgattaagaataaacattctctctaaagcccccaaaatccctttattatatgttaaaatcttggaagggtctgaacttcattaagaaaaaaatgtaagaagcaactattagaataaatattattctttatctttctcatctctatactgattgctatcaacatgcagtacttaattttaacattctgatatacagcattataaatgtgcaacccaattacagaaacactgataggaatgaatattacatattattcataaaatagagatttggaaataagaatatatttcttcatggaagcaatgttatatataaccatgtgatcccatgccaaattgtaaaggccacttaagccatgatatggttaaaacttagctttaaaatacctaattactaagtaaaatactgattatacacaacacatggagaattatgggttttaggagcagagtagccctatcccctgtccataaatgcagcagaaagaggaaaaaggaaataaggcatctctgagtcctggaaattatactccagagagattcatccaaaaaagaagaaaaacaagtaaaaaaaaaaaaaaaaaaaagcttgtcaaaaaattctagttatcagggccaggcgcggtggctcacgcttctaatctcagcactttgggaggctgaggcaggcagatcatgaggtcaggagtttgagaccagcctggccagcatggtgaaaccccgtctctactaaaaatacaaaaaattagccaggcatggtggcatgcacctgtggtcccagcaacttgggaggctgagacaggagaattgcttgaacccggcagtcggaggttgcagtgagctgagatcgcatcactgcactccagcctggatgacagagtgagactctgtctccaaaaaaaaaacaaaaaacttatagtaatcctgatgggaacatttataagtcagactttctaagtcagagacagataacactccacacagagaactcttgaactcttgatattttctgcacagtatggaagctattggacaagaagcctttacagacaaggttttttttttaaggcctactgacaagtacaatgcacacttttaccagtcttgtaaaactattttaaaaaccagatggtataggaatggaaataaatagatctctttaaaaaaatataattttggcaataatatacgtttcaaagggcaatgtaaaaattctgtttcaaatcacctctacatgggtcactaagatactttaacagtaacttatgccaaataaaaacttattaaaaaataaaaccccgaaagttaataactaagatttctattctttctaaagactgtagatttgttaaatgtttcaattgttagtctattcgataagagttgggattttgttcagtggctctcaactgagggtagttttgccccgcaggagacatttggcaatgtctgaaagcattttgcttgtcacaattgggggaagattactacatttatttagtaggttatataagttttcataacaaattaccacaaattaggtgtcataacaaatgactacaaatttggtggcaaaaacaacaaaagtgtattctttcacagttctggaggccaggagtctgaaatcaaggtgttggcaggaccttcctcctctgaactcttgagtgaagaatccttccttgcctctgcctagcatctgggagttgctggcaaccttggcattccttggctgttggtagctgcattagtccaatatctgcctctgtctttacatgatcatcctccctctgtatatgtctctgtctctgttcaaatctccttctcctttttttataaagaccagtcattaggtttagggcttactctaatttagtatgaccttattttagttcattacatctgcaaagaccctactcccaaataaggtcactttcacaggtacccaagatcagggattaaacatatctttttggggtgtacaattcacccaccgcatatgtagaggccagggatactgctaaacattttaggataacagcttgccacgacaaagaattatccagcggaaaatgccaacagtaccaaagttgaaaaccttgattttgaacagatacatcagcaatactgattcttcaatgtgatcattcttaataatcttccaatggccctgtggccctaaattcctgttctgcatagtttaggtgcagacatttttaaagtgtgaacattttttgccacccttctctcccaagaacaccctcctgccaggggcctattttgaggactttttatgaagaaaaaccacatgctggagggacgctgaaatgcaaaccaggaaaacagttatagctattagctatctcattgcttttggctaagttacaaaagcactttgggcttcaagatcaatgaaacaaggtatctaaattccctttcaggttctcagaagtatataattgcaaggctattaaaagcttctggtttgggattagggacacattagtacaataacctcaataacttcaaaaatgccaggaaaatgctattttcaaagaaaagaataacaactctttaaaggtaacattcataatttctattctaacattatttgagatgttctatgtttaaatagtggcaatttttattaggagtagagtttatttttagcaaagtgttgtgaggtttgttctcctacatcagcatatatgtcataagttattaatttctaacgttcaccttatattgtgccatatgtgagaccagctgtacaaagttaatgtgaaaagattacactttagaacaaatagcctcaacacatgtgatttgtttctgttggagggcatatacacctttggaaaatgatacctaagaacattaacagatttctcaactactgttttagtttaatacctcggtaaactgaagctttctcaggtaaactaattatttttgtttcttttcaaacaatctcaaagtagcagaaacatttcaagaacagaacattttcccctctgaaccatatgagtaagtttctgacctgatgcttcatgccccactaaaacattaccgtctatttcctacaaaggacattccccataccatcacaatacaaccattaaaatcaagaaatgaatatatatgaagcaccatctcatccccacaccccatctaagtttcaaaaaaaagtccctataacgcacttggtagcaaaaggttccagctcagaatcacacattgccgttggctatcacttctctctaatgtggcttcactctggacctgtgacagtctcttctgacttttccataaccttgacactttttaaaattccaagacagttctgctctaatatgattatatttgaggtaggcatctttggcaggaagatcatagaagtgatgctgtgctcttctcaccagatcgtctcagatggcataccatttttttggtctttgatcatttgatcaaagtgctgtctgccaagcttctccactataaagttactctttttcccttgatattagtaagcatattctgaagagttactttgaatctttagtactttgtaccccatcaaagttttcattgatttattttttaatttgcttcagttggtactcatgaatccccatattattaaatgggttacaatccactaatattattatttattttgatgctcaattttgtcccagatttgtccagtgggaaccccttcatattggctcctgtatctttttgacatgactcattatcctttgagcactccattgctttctggcacaagatgttctaggcttatctgctactttcccacactagccctgaaatcagccatttctccaagaagccttggttactattagtaaagaatggtatttagaacccaagatctgggtgctaagtatactcatcactactggaaatcactgctaagaatacatgtgcacatattcatatacacatacaacttataatgtatatcatatacacttatgtatatgatatgcatgatacgtattcatcatacatatatttacacatatacttgtttaaagctatatacctatatagacttaagtaaagagatagggatttaatgtcatggattcccatggatactgccaactgcaatccaacaccacagggttcattctactttttctctatctttatttcattcttctctagtgaaaaacctagatcctattatctttcctagatttaattatttgatccatcaccctgtatactgctaaactgtcattgctactgccacacctgtccccacagagatgtctccttacccactcaggctccaacctccatcgctggtctgaccctcctacatgctttcctccacatcttgtttgggatcaaacatcacccatctgctgctcctgcacaaaagccttgttaaacttgctcaactctgggatcctgtgtcaagctgcccgctgcaggagcaaccattcactgtgctcaggccctaatactccacaccaggctgccctcctgcctgatgccatccttaccagggtcagcctcagatatcctgatctggtccccttgggctccacccacttagtgaggatgtctccttgctcttccccaccaaataactataggacctatggagggaaagatgagaggtaggagggaagggaacgagggtgacagaagatgaggaagagtcagttgccctaattcttaacaaatgttttcaacatataatttttttgtgatgataaatttagggtaaaaatggtcatgcatcagaaacatcactattaaaagtaggcttaggctgggcaccgtagctctcgcctataatcccaacactttgggaggctgaggcaggaagatcgcttgagcctaggagttcaaggccagcctaggcaacctagtgaaaccccatctctacaaaaaatacaaaaattagccgggtgtggtggcatatgcctgtagtcccagccatgtgggaggctgaagtgggaggatctcttgagcccagaaggtcaaggctgccctgagccatgagtgtgcctcggtactccagcctgagtgacagagtgagaccctgtctcaaaaattaaatgaatgaatgaatgaataaataaataaaagtaggcttatggttcatctgttccatttaaacagattttggtctttgatcatttgatcaaagtgctgtctgccaagcttctccaccataaagttactctttttcccttgatattaatgagcacattctgaagagttactctgaatctttaatactttgtaccccatcaaacttttcattgactcctttttaaatttacatcagtgggtactcatgaattcccatattattaaatgagttgcaatccactaatatcattatttatttgatgctcaatttgtcccagatttgtccagtgggaacccctttaaatgtccttaaaggtaaaaactgccagcatgttctactgagatatggactaacaatgtcagacatatgtgggtgcttgaatagtatttgcttcaaaaatatttattactagaaagctgctgtgtttggggtgagaggttagtagggaagggggttcataaagggaatgcaaaagccacgtcctctggaagttaaaaggatcattttaaatgattctactgcaaacatttttcaaaagataaacatgacccatttctccaatttgtgtcatgtaatagtaataataatgatatttaaatactcccactgatatatcctttacaaagatatattatatgtcttatttaatcaaaaaaccttaaaacagtccctgtacctaattttattccaggactcaaactgtgtcagcatgtcattcagtgcaaatcagacatttagatgcataggctatgctgtcagtagttctgaactttcatagacatttccaattagctcggagagacaactggatattgtgtttaagcactgtgtttaggaaaacaggcactggatggaccaatgccaaatttcctgctctgctgcttaactaagtatgtgtaattacttgggcaattaagcaattacttgggcaattacataagccaagccccaatttcttcatcttgagcccagaaggtcaaggctgcagtgagccgtgaatgtgcctctgccctccagcctgagcgacagagtgagaattccccaggagtgcagaggttctcagaactgcaatactctgagatgaattttgaaaggtgaatcagggatagaagaattagggatacccagaaaggagaaaaatgttctagacaattcttttttcttttttcagctggaactaaaaaaatgctaactcatagggctatacatttataactattcttattattaaaatttgactcaaagtcttaggttaacagacaacctgtgtctaagtatgtaggcctatacatctaggtcaaaaatatccagtaaacctcacaatatcctttggcaaagagaaaaatgaatttcccagagatcaataccgaatctagaaaacaagctgagagtgcctgacaatttttaattctggcttaaattcgatgctaacttcataacttttgtcttgtacattattccacaattttagcttacgtggagctaaaagagcagaacttataccatatacatagagtgacatcccctcccccattcatcttattgatttacaccttcatttattccactttcatttgtttcctacctttttttttttttttcctttagagatcttctctgcatatcaacttaaccctgacgcctatggaataagtatttacctaacagtgcactgtctaggccatatcattttaaagctgtggtttttaaccagcttaaaatcacatttaaagctacatggagagctgatgaaactccttaatgcccacactgaatcccaagccaaatgaaccagagttttgcgggaaaagatccaggtatcaggatttttcaagctctctggtgattctgacatacagtcaagtagagaatcaaagttctacaatgaatccagaatgcactggttctcagaactgcaatactctgaggtgaaccagggatagaagaattggagatacccagaagggggaaaaatgtcctggacaattctgtttctttttctttctttttttttgagacagttttgcactgtcacccaggctggagcttagtggcaccatcaccatcatagctcactgcagcctcaaactttggactgaagcaatctttctgccttggcatcccaagcacctgggactactggtgtacatcaccacaaccgcacttttaatttttttttttttttttttaataaagaagggaccttgctatgttgcccggggtggtcttgaactcctggattccagccatcctcccacctcagcgcccaaaagtgctgggattacaggcctggacaattctttataagtggtattatggaaaagagatgtggcacaaggaaatctgcgaaggaacccacgatgttctgtccaagttgttaacaactagacgttttaaaaggcatttataaaaattaatagtcttaccttttgattatccttccttctctatggtgtgttacaaaaattccacatcttacaagcccatgaaaataaattcccatgagagtttgaaaactttttgcagaataatgtcccaattttagttactggtggccaatatttaccagcttgagaggtggtcttttattacccttactggctggtaacatttatgacacagaaacttgcaataggttggatggaatcctttcaatatgaaaagtaattataaacaggtgaaggtagaatggcaactttcgtgttggctttgttaatgttttgcacgtaatccctctgtcaaagtgtcttaaacaataaaacaacaagcaaaaatctcacacatacacacacacacatgcacacacacattttgttttcaaagaccacggtgtaaaatgaagatacacacacgttatcctgtaagttgtggatctttggttggctagttggttatgatgttttttcccctactcagctctaaaaaaacatcctcggcaaggtgaggtggctcacgcctgtaatcccagcactttgggaggccgaagcgggcggatcacctcaggttgggagttcgagaccagactgaccaatgtggagaagcccagtctctactaaaaatataaaattagcccggcgtggtggcgcatgcctgtaatcccagctactctggaggctgacagaggagaatcgcttgaacccgggaggaggaggttgcggtgagccgagatcacgccattgcactccagcctgggcaacaagagtaaaactccgtctcaaaaaaaaaaaaaaaaaaaaaaaaaaaatcctcaaagccaacccacctgccaagaggagggaaggaggtgatactcgagccttactctcgaatcaagaaaagggagtaggccttggggaaatgtggctttcaaaattcatgccatatttgcccaagccaagtcgctagctggtccctgcaaccacccacacaccccactgccttcttcctaggaaaaaccagactctgccctgttacctacgcgcccgactcgcggggcgctgttcgttcaagactcgccccaaagagcgcaggaacgcgagccgcagcagtttcagggttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggagggcgcgcatggcgccagagggtccgcctgggtcctcgtggagactgctccctcagctcgccgccgcgggtgtccagagtccctgcgcacactcgcaggtggcccggcgctcgcagccagtgccgcgggtaggacgctgaagaaaaggcggaatgggaggggcccggccgccttgccccactcccccgagacgctcttaccgcgcccggccctccatcagttatgcagccctcagccggctgctggcgttcccggatgt

SEQ ID NO: 223 - DNA, 442486 bp, Homo sapiens
  source 1..442486: mol_type = genomic DNA
aactccacctgtgccttcctgggaaactaccaccagtttcaaatctcaataagatgttagtttcacaggaaatgtggagctgaacaaagaaatgatgagtatgcttggccaaactatgcagcactatattaatatttctttgctaaattttttataaaataaacaaataagccgattttttaaagtaaatataaggatatgtaattaccatctaaatgaagatttaaatttaaagagacatatatattttttgttcttttgtgcaaactgagagtatgggattctttatgaagcaattatttggaaattaaatagttatggcttccttcaaaaataaaactgcagatttaattaacgaatattaaatacagatcaatctactgataggcagtcatgttctacatatatgagtaaacatgacacttcttttagtcaactaataggaaattcaattagaaaaaaattgaattattcaggtaatatacaatattaagaatgtagaatagaactaaaagaaaaagaagtcacataatctcttattagaaataatgaaagtaaaatgagaattataatatcagtactgcatgttacatattcttctttaaaattttgtaataaacattgacagtgtttggtaggcacagggaaacaggataacgtagagtcattacagaagaaaaaaacttattgctaacattgcagtattccttttatcagaattaggtgagtattgattgtaaaagctctatcaactcttgctcttatttgatgactttgagacttttttactcttgctataaaaagaaggctactttctttccctaatatatttctaccaatgcgaataattcaggaaacaatgagagaaaagtaattcacacttaatgtgttgttacttaagagatttgacggataaaataaaatcaaattaaatcattgaaaaggcaggcttagacccccttaaaaacaccgttagttgcctaccataatttgagcactttttcatgaaaaaaaaaaaaaaaccattcagtttcctacagattttgcacagttcattccatggagatacttttagggaaatagggaagagggttgtgaaatgtagcctcccctcattcctcctctgtgcagcccagcagctctgaccgcaatgtgatcctcccgtaccaggaccaaggaaggattcttatgtgtcgtgcatagatgggagggtcgatgacattttttctgtgagtgtcattgtcaaaatttccctggaaaacctaataaagaagagcagaaaaatgtcagtcacacagccttctttctttgaaattatttttatgttcctgtttggaacattttccccaaacatgatatttgataactattcattttcttttcttcaaaatatattgcagcttctttttaataataattattttaaattaaatggtcaattaatgtttaaagagttaaacctttattgtttaatgcagacattcataggtctatcattttcctctacttgtttctctcaattaaaaaaaatacaacaggtattcattttttgcttatgtcacaggctgacgttagtcatgtagcttgctgaagatgctctcttccacggggtgactcagagatccaagctgcttgcaaagtacagctatcatctggagcaggcggcctccacattcacaaggggcaaggggagggagagttagcagactgtgcagagtgtttaagagaacaagcatggaagcagcttatatcacttctgtatatatctgtttcaccttacctaattatatgactccagcctaacagcaaaggaggctgggcactggagagaagcacaaggctatctggtgagcactaacggcctctatcacagtgccttttgcccacttcttctcacatagagaataaaactagcccatctccaaatgagacaacacaatcaatgctgtttttgaactgtttttctcttcttttttggcttcatctattaattcctggatccatacaatactattgggatgaatatgacttataatatcctgaccctttgcattgcacgtctattcttctttcttcttttgtaaaaatgcttttttttttttttttttggagctttactattactatggccacttgctcttccccaaaagactttcataataacttggacaaatgtctgcttcagaaaacaaaacaaatttaaaacactgggtccctgataggaatggcattaaattataaattatgttggggtaaactgaggtatttatattatttagtctttatctgaagattttatcctttttttcttatagattctgaacatttcttattaaagtgatttctaactattttatatctacatttttaaaaatttagatttagtttagatttttagatttagtttaaatttttagagtaaaaatctcttcaacgctttctgtttttgctttatgaagcatcttataattagaagataattttctttcttgtttgacatcaaatttctttcttgtttggcatcaaaacataactatgtggccagagacacctgaagataaaatccttaaagtagaaaacaaaaaacaaccaaactccatcatcacatgacaggatacttaacccacatctttcagcattctgaaattaaagggaatgttttaaaagccttctaggctagattggttcagtcttatacggccacaaatgttctcctggaaagaaaaaaatcatattctcctcaaaagcattaggcagtacggcactgattaataggagcaatagacaagactgaaaagtctctctgctggttctgctggcatatctaaattcatattcatttagcaggcattttatgcttagtaatgccctgtcttgcacaaaggaataattcattctggactgaaatgtgctactactatgttacaatgtctctgttagcaaaactcacaggtacaggacatatcataaacactcaccaaaaatcttgagagactgttgctactgcaacagcagaaaataagccctggtttactgacatcctctctgacatatgatgttggattcaaatatttcactgagattgtggtattacaatttaatacggaatctaaaatccaattttgtagccctgctagtgaacttaatgtatatctctgggataatagagtttaaattcattaactttcattgcaagatttataacagcccgaaatatagttttataccacttcttgggaaggaaatacagaaagaaacaattttctcttaagtgtctgctctccagcacaggttttgatgcgaactatcaacccagaaagtattagttgaattattaattatacttatttctttataatgaagaatacatacagagaaactatatcagctctggaactgaaaacaactatgaaatttctgatttaatatgtgaaagtcatggatatttgcatgttcacttaaaaaaagtgaagtttcacgaaacaggatgattaataaaacaataacgttcacagaaaaacagccgaaatctatactagaatcacagaatttacagcctcaaagtactgaaaatatatttttattttcagaggcctctcagtaatgacacgtacagaacacaaagcacccacttgctaattccaggatgatattttgtacttgttgtgtaaacatgtggcacatgtgctgttttcttatctcaagcactaggaagcccctgcttaagaatgccacctaaatatttcaccttgcaaaggaatgcaaacacagtatttttagttaacttcataaaatctctaagatttctagaaagtgctttcacaggcacattttagagacataagcatctgaactaaaactgaagtctgaaaagactgatagagaacattaaatctctatataggagtgaaaatattttacatgagaaagacacagttcaatttagaattttttagaaaaactatgcacaagttccagttcaggaaggaggctaattggctgatcacaaatttgctgatatattcaaacatgatattgcttagaggtctctcaggctttttctaacatatggggccttgatcaaaaaacactcaaggtactttgcagaagcttccataattacaacctaagagaagataagagaaagaaaaatacaactccctcaatgtagctatcttgattttctttttcctaaggttaactctcttgtgatgctggttgaaaatacaaatcagattcttcagaggattcaaatctcagcacggagagaatatcagataaaataaaacaataaaatcttgtttctagcagcattaatacattttttataagacgagctaccattctttgttaggactacggtctattcaggccggtatagacatcaataggaggcctccagggatcatggaacaaagtaacattatcctccacgatgtagtcagagaggtggggcatatttcagtttcttttagcagtcatcgaataggactctaaatatcaaagaatcccttggggacttcttgcacatatgatttctttagaaaattatctagtttgtaaaaatgtgcttcttttcatttgtcctaaacttaactgattaaaagttttaaagagattaccattgttctaactttttggaattgctgttcacatcattcaaatagcgagtggttctaagcatttttagatagattccctatggctaaacatcagcattttacatcagtattaaacaccagtattttattaagatttcaagtgaccatcacttcatccctctgggtttttgttgcccccttatagatttcattatttttcttctgctatttggagactatagtcgaaccgcatctgggatttcagatattgtggaaatataaaggttgagtgagactttctaaagttttttctattgattgtatttgctttgtttatggtatcaagcataccactggccttactgactgtatctgtacactgacctgctgttcttaagggatagaggacaaaggtaaagatccattttcctagggcagcatgtatgtgtctgtgtctgtgtctgtgtgtgtgtgtgtgtgtgtgtgtgtgtgtgtgtgcagaggtgctgggctgaaagctcagaattctttatttaacatacataatttcaatcctttgagctttcatccagagcactaatggagaagttaaataagaacagtctttggtagctctgatcctcagaaaccctgtttttatctaattctacccatataatgaaagaatctgagatctggaagagaactcagagatctgctatcaataacttttccctctaatatttctaacatggaactttcagcctattcatggcatgcctcaatacaataggacaggtatgtatttagacagtttgaaagtctatctttttagaagactaaaatgtgtatctctcacttcagtctattgaatctagtgcttaattctcaatgaatatagaacaaacttagctcatcaaaagaacttttgacatacttaacaataattgacacaaacctctcaaaaactcaacttcagcgctctaggctaaacattcatagttccttaaaaagttcctcatgttgcatgattttcagacttataatcttgattgcattccattgactaacatctgttttaactatggctcagtgaaagcgtggtatttattgggacacagaatgtagacatactgtgaataactcaaaagatagagtgcgcctttgttgtagatgcaatatttctatcaatgcagtctaaaatgtagaataattatattgcattttgggttatagttgattgatttatggtcaaatagattttggatattttcataatttctcctcagtgagggttttccaattttttttacttgtatctgttttataaagcaaccatttatatattatataagtatataattctgatttttgtggctgacataagggacagatgcttattaatttatagttcaggatcataaaatttatttttatatacttagtgtcaacattacttcaatttttttgactgtcaaaaatttcagagttacaacttgaatcaacgctttaagtgatgtaaagtcttatgaaaattttcacggaattagtatgcatgaatcacgtcaaacataacatttttccatttgaacagtttgggaaagagctttctttgtttctaattctagggctagattttcagtaatattttaggataatctaaaatttatgttctactttgccctatatgcaagcattccaaaaatcaaattttttttattaaaaaggaaaaaaatatcaaaatatatagaaaattatttttaaacattttagttagtggtatacatctatatcatattaaacaaatcttattggaagctttgcatgtatgaaacttctataagtgattggctataaaaagtctgaaaccaaagtttaattcttttagccaaaatagactgcagctatcattctgtgaattcaattttctaggaaaatttaccagcatcctgaaaccatttcatgattgaatggctagtatattattcttgatgtttttctctgcaatcaattccactaaaccaatgaaactctgtaacaaaattagcctcaatatgagtacattcttccggatgtaataaggaaacaagaaattcatttccagataaatttcaatattctaagaaatgtttctttggaaaatagtgatattgagaattatattctaagagggtcaccaaaaaagtaggggtttctgttggagccagtagactttgttaataagtgtctatattgatcatcagtctgcagaatgagctgggggatcagccttcactacagggcagcccaacaacactacagcacaaattgtcattgacagaaaggaacagagagctaccacagtgtcttccatcccatagcatcctgagtggaaccattaccctccaaagctgaaataaggtcataactaaccgaaacaatttatcagcaggtgaaagtcaaatgaaaaaaaattcaaccaaaatgtatacataagaccttaaagtagagccaaagacaatgataaagttacatgtcccagtttgtgaaaatataatgtgtgtaatctacagataagagatcaaatgcgaagaggacttgttttcatatcaaccactaattgtaacatattagacaatcactttatttttctgtatccaaaaggagttgatcatcttgtcttctttgcaagaaacatatctagacacatcttaatcttgagtttgcttgtgtgtactatcttgaagtaaattgctgaccatcatatcttttttctattgaacagttcttctgcagagtttaggatgtgtcaaatctagtgtaagcatagcgtttacagacacatgtcattccagtgatcagtgtacagtctacaaaaccgtgtgtaatacgagtgtgcagtagatgttaaccttacccaaggaggagtctgtttttcaccctcagcaacttgaaggtaatctctaagcccttggaatggcctgtctgagaagagtatttttgtttcccagggggctctgggccacaccagatagcctatgctaacattgtggtttacagtggggtcttcaggtcagcttgaccactgaaaaggaggaaactaaggttagccatacagatggtcaaccatgtctaaatgtaggagcttccacaaaaactctgaataccaacgctaaggtgagcttcctagttggcaatactctgggcttactgtcacgtaacattgctgagagaacttactactctccagaagtctccaagacaactgaaagctcattcctggactctcctggactctgccccatatgtctcttcccttagatgatctgtatccatatcctttcatcgtgataaacgataactgtatgataattttagttgtgtttgtgagtttttctattgaattatcaaacctgagaatgatcttggggaactgtgaatgtgcaattgatgtcaaaagtgagggtgggtttagggaatcctgaatttgtgatgagtaattggtattgaagggctacaggtttcatctaagttttgttgtctgaaacattgacagttggaaaaggaacctcaattgtctgaaagggttgtatctacaacttccccaacatcatgcgccagcgtgtgacagacattcaggctttaaagttgattgtgaacttactttctattctgattctttgaataaatcctcaaaggacaatccattgaaatttgtttattttggcccataagtatactttctaaactttctactgttaggttctactctctctattttacttgctgttcttattttcaatttctggatgatatttattctcatgggcataaacctaataagcatatcaaacaaccagtgttacttgtcctcttgcatatttcagtaacaaaaaatccaacttctttattctcctgtatttctttaatatcatttccataaaagcttataggtcctttgagaaatactactttgtccatctacttgggtttcttttgaaatcccttaagaaactgcagtcagattttcttaaagctatcgtgcatggtcatatatataataattctgcaccataattcatattggatattaattttatctatgttctttttaaaatgatgttttgttccataaaccctttgaaaaatctagaccctgtttgcttcagagacttctttgcttcccaagatttctccatgaaactacctgaggctttcaaactgcttatttaacttcaaaaatctaattatagaacatttttgcttgatgggagaagtgaaaaacaaaacatggggcaggttccatagtctctctttcacacgggcatgatccatttaaaccattaaaatgaatatatgggttctctaaaaaaattatttccattcccattgttgctctcaagaaatttcttgtggctctaaagtttgctttctattgtaactatgtaaaaaagtagatttttggcttcaagaaatactatactttactgaatgaatctggctttgcttcatgttcctcatgtatataaatctctgattatagcccaagaaattctttactacaccacaaatttgatgttcacttacaattcttgtagcatgatttgcactctactgctccttctgttagattttttttttctgaaaatgcacaaatgaaagattccaataataattggccaaaacataggcaaaggtgtttttttccctaccctggcaataaaagtccacatttccggcccttcattgcttctcaaattgccagattctctttggtttccatgtagttgacatgaaagctggtttgggaacatatttcttcattgggaaagagaactgtgtgatagctttctaaaattcattatttcttagatcctctggaatttgagagtattggaaaagaggaggaaatagcacatttttgatagtattttttttagaacatttaacttctggcttttcgtagaagagttcaactgctcctaaaaagatatgggattagggaatcctattctgcccagtagtatcaacttgtctattactggcaagctggcataggcaatacttgtgattccctagtccactgtgagagtgacaagttgagctaggaattgccaacatcccagtcagcccgatgagagaccaaagggactggggcagagtggccatctccattcattctacggactgttttcttgcataactttggctttaagtagctggagagctggtagctctttagaaagagccccaagagcctcactaagaagttcatgttaccttttgttattaggtcttgaccttgggaaaaagacgtagtgaaaaatcaaagcaaaagagtccatcctccttgactgttaccttcctttccccaagcttgctgtcatttagaatgtagagtctaaaagccagtaggtaggatacaccaccatatttaacttcttttatgatgaaagtctccttaagtaatgacaatatcttaggaaatatatcacataggatgattgcctataaagatttatgaaacataaaatatgccattctaaactgtggctatatatttaaactatctgccttccactactcagattttgactgccataagaaatattcccacagaaaaagtagaattgggaaaccatctgcttttcaaagacatctccaggagatattaccaggaatagttggaaagtaagggcatctacttttttctttttagtagaacatgagaaatgtagaaatgcctttcctcttttctataaaagtacagagcaacttgcctctctattgaagctcaaaactcatctctcaaactctcatctgaaatcacactatgtattttccatctcatcagaacaatttgagactctacccctgactctacccttcatggtagatatataaatgatgtggcagtagagaaattggtgtatttggtaattcttcccgcattaggagacttttcctcacttcaagtctcattgaagagtttcaccctatccttgtcagaaatgacttaatatcgagctctatgtatgaacacagaagtgatttaagcactcagccatgtgacttctaagccagactcatgatgaggggaaaagagtattagggagaggagacaatcctggagatggatgcaggggtggcaaagtggaatcgtacagctgaagcagggtgcctaggtgtgagcgtaagcatgtattgcctaggcacagaaagtagtcattctcctttatcctctctcctgagtatcctcagtagaccatctggtccagctacaagacatagaagatcttaactggaaacaaggttgcaagatcaaatattttgaatatacttatactaaagaatgtatcatttatctgaatttaagtttaactaggtgtcagtatttttatttgccaaatctggcaacactatatgaagaacatgaggaatgctagacctaagctgagcagtcactaactcttctttgggataagctaaattttgggtcttttttcttttcttaatgagttgagggcatattattattaaaatatgcttgatctcagaagagaaaagtaaactttgctattacttatggctattggggtattaccaaaaagaagaaaagaaataaaagtgcaattttgttatgtaaaagttatattattttcactcatatatgaggaatgtcttcctttaattattattaaatatcagacatttcatttatctgttcaaaattgatgttgtttctaactttactggaaatgaggaaattagttcttgtgttcagttttctgagtttggtcctctgctcacagcttcagaaaaaccgagaggactgcctcttcacacaggtataataactgaatccatctttggttaaagttattttttaagcagttttgtgtctcaaattatgccagaagttttttgatgatgagaaatgtgttgcctctgtaataagtgtccccacacggcttattacaggtgtatttgtcccaagagtgctctattcatattaacacactttctctttgagattcaaccaaaggaactacgtaaaaatcattgccaaatgattaactttatagggagtggcagattcagaaatctttttatagtttcccataaacatggatatatgacaggtatcatttgttctttttcagatttaaactgtgaaaaagtagaaaaatactgccacattaattaagacattgtgaaactgttaagggggagacttttaattgcttaacatattgcagctgatggtgtgatggtggatagtaaaaatggcaatatgtatcatgtagaactaaagtccttgagcatttttttttatcatataataaacaatcaaaatattagttgtttggtgattatttagaaataaaatgggttgaaatttttgctatattctaattgatatagtttggatatttgtcccctccaaatctcatgtcaaaatgcgatcctcaatgttggagctgtagcctagggggaggtgctgggtcatgggggcagatccctcttgtatggcttggtgccctccctattgtattgaatgagttcttgctctattagttcacagaagagctggttgttaaaaaataatgtgtcaccttatcctctctctcttgctccctctcttgccacgtgatgagccttctccctccttgacttccatcatgagtaaaaaaagcttcctgatgcctcaccagaagccaagcagattctgttgccattcttgcacagcctgtagaaccatgagccaaataaacctcctttctttataaattacccagtcttaggcattccttaatcgtaacacaaaatggactaacaccactagtcaatggttactgcatacttaaactatcaaaataatgacatagtttctatcatactcagattgatcgagtacttgttttcctagtaggaaagaaaactatcagattcacctaaaatagcatcgtagttttttctattcaaaatgctaattttctctcagctaacatctcctgctttcatcaggttcatcactacctcttaatgaatgataacatcactgaattttaaacaatttattaaagtttgatagtcttgatcattctactggggagctaatcgctaatcaatatttttaacatgttagcatttttaatcaatgcatagagtcacagttgggctaacacttgatgatttttcttagtagttgtataagaatgacttaaataaaagcatgagtaacttttttcactgagaaatattgtcattatgcaattaggtctattaataaataagtcacacacaaacatgagatattcagaattttaagtgtacacgtttttagtgatttctgatgagtggtggaagattgagaagataaaaataggaagattttaacttttttggcatttgagcactgggaaaagtaaggtgataaagcatgtaataataaacaacatttaaattatttttcatttatgaatattttactttgataatactgctatgtaacatattccttatgttttcacacatattttttccttttttgcagaaacgtgctaactagaaaaactatattgtttcaaactttaagggagtttatcaaactccctgaaaatgtaactctgagttttggagaaaaaagataattagcaagaaaaaacaataagcatgtatttactccttattatcatattatcctgacttgttttctgctttctccataaatttattgagaacgatgtttcatagcatctgtactaggtggttatctgtcattaaataacagtcacaccagtagggacattcttcctgctccttgcccccaacccaccctaatattggtgaattttatgaattttctgcctgatgtatatttgtttctaccacctaattgttgttagacagctttctgcttttgctcttttgtcttttaacgatgaaggttaaaacatccaaatgccaacaagaaaagtaaatgattcattgtccaaaattaactgcatatttcacattgacagtgtttaatattagaaaatgtgaactaatatacaaaggattttcttagaaacctcaaaattaatccttaaagaaggacaactggctttcaattgatgtttccaaataaactgaatgacttcttaaaaaatcactgagctccttcagacagaatggcttctggttgttcctgtggctaatgagtcactctggtttgtctttcatttccagcatgtagctagttgttccattctacagttgcacttacattgggcactagccctctctctgctcatctctatcccataagccgcacctcctgttgtccccttcctttcctgctcttaaacccttctttaccctgcatccaagaacaaacatcttagttgttcttggatctaggtaggacacttgcagcttatgttaaacatggaaatggaagcataatacttttttaggagacccagggctatttgcttgtggacttgcatccatttttttctgtcttgtttttgaccccaggcctccacttcacaactgattctgataagtgggtccctattatgttctctgtgtaccttaacaactgctatcacactactcattgatgacaatatgctgctttctgaattcagtttatttaactagattgtcctttcccaactcagcaggcagatctaggcctgcaaaccactttcactttgctaagtcaattattctgtacttagatatttcctgatacatttcattcttggtcagaggccttagcaaaatttacaagcatcccattctattttgggcataccagcacatatcctagtcaggtctcataatattaaattacaagtagaaaagcagagaaacttctgaataacagttgataccaaatggtatttatttaaataacaatatccatgatgtgcttattacacattgcatgcctgtattaaaacatctcatgtaccccataaatatacatacctgtctatgtacacacacaagttaaaaatatgcaaattaaaataaataaataaataacaatgttcttatttttagacgatttgaaataatataatggtcttcttaactttagtttcaattaagtcactcagccactgaataagtaaaataaagtgactacatgaatttctatcatgtaggggcacacttcacttgctattactgaatcctagtgttttgtataaagtcatgtattttttggaaattgctttttggaaagcagcctccgttccttccttctctgccttatttgaaaagagtaacaggactctgaatggatgaaactaatggtctccatgcaatatggagtgaaaccgtccttgatcctgctgctcagaaacatgcagctgctccctcttgaaagacaattcactccctttgcttttccccctgctatcatcttcctctgtgattgccactgacaattccattttatttactccctaagggattcttcaggttctaagtttctcacccagatcaaatttcaaaagaacagcatgagtattattgactactcatctgacctctgccttacccatgagttggactttcaaggtattaaacattcaaatttaatttcagctctccaaaactactcacttcagcagaaatgacaggatgctctgtgacatctgtaattactgttgaatttgaatatatccttcaatgcagaccatggctggcagctttattaatggggactgatgatattgctgcttctatttttcacacccatgttgagaaagggaaggaggttgaaaaggaccagggactcttttcttctattggagagtgatggacttttatgaaactgacataatctatgtgctacttcttccctagagttgttttatcaaataatatacctagtaggttatattttgactttcccaaataaacggattaaatcaaaatttttccacctttactgagcttctcattagactgggagactgtgtcatattcagatttttttctcacatggaatctgccaactgaatacacagttggatgaatataaatttcacctccttctagatgatccccccatctaatctgcatcctaagctacttaaatatattatttcaatttaaaatttgtttaaagctagtgtttactttgtgattttcataagggaattggcaaacttattaaaatttaatcttatttttagaaacattgattcatattgacttcctctgaccaattagaggccaaagtcctaaagaataataataaattccattctcactagaaaaacagaaaactacacttagtttcaaaaatttaattttgtttttggcatcaattagccatttttcacacacttgcttattattagctggggcctctgtaaacatttagatttccagctcatctccagagagtctgaagcagggcccagaaatatgtatttttaaacaagctctcctcatgagtgccataatcagacaattatggtaactactgaattagagagttcaccaagatattgcagtttatttcttgatgaatatacgtgtgattcctctttaaggaccaagaaagtattattggaaacaggggattttgttttctgttttggaaaatccaggtaaagtttcaacttttcaacttatgcttttacaaaaccctggataattttagggagggagatgaaatagagtattaccagcttctttattcctgaaaaaagaaagctcctatgctgtgaattcagacttatttaaacactacgatgttatgactaatatactggatgagaaaacccatttttatttctaatttttccatataagtactcttcctgaaatttattattgctttactttggcttataacctgaaaaattaaatactgaaagtgtttgtcaagttttgcagttttcctgctaaatgcagtaaaaaacagctccaagtgtataaaacaaatgtcactttcataagagcaaaggaacatttgactttcaaataaaaatgtacctgaattaatgctgtagagaaatataaaagttagttaaatgttagaaaatgctgtagactagtaaggggaaaataaaaatgtatggactgtaatgagagtgtcatcacaggctcaattacaagagatttaatgtggaaattagctaaaaaacaatactaaagtaaactgcaattcttgtgaatgctataggagggtattcaaaaactgacatctcaattaggagaacagagtattatttttcttcagttgacttttggcatgtgtgtgtacacatgtatatttattacatatatttaaatactcctgtgtgtgtgtgggtgtgtatatatatatatacattatatacatataatatatatacgtatatatatatacggcattgcttttctgaggcttagtcactctgattaataaaaaacaaaaaggccattgatacatttttcgagttttataccacttactgtaaacctagaaaactgcatttattttcagattacttttctgaagtaatcttgtgtctggatctacattagacttccacacccaccctccaaaaatctattaaagcaagcagtcaataaaaacaaacagcacaaaagaagacttagaagcttttgtttatacatatttctgtttgaaaagtgcatctataaaacatctcacagacacatgttttgccctgaaacattcaattcatctattatatttgtctggatgaaagcttgtggttgaattggcacttgtaaatattgaagacttttttttcctcttatggagagtaatcatggaaaacaagacaaaaataatgttaagaatcaataggagatggcttactcaatgttagaaaaaattaattgctaagtagtattgagcccttttaaacagaagaggacatctataaaggatgtatgaaatgatacataaaatatctagtagaactagtaataataaagcaaaagagttattttgatacctatcaaaaacatatttcattgatatatatgtatatttacatataaaatgactacattttcaagtgtttaaataacttaggcaatacattttctcatttgttttataaaattcttttctatgtaaaaatggagagacctaatgctctgtaattccttcttccccataaaagatttccttatgataatactaattactgaatttttatctacagtttattggtgtcagttgtcttcttcaatagtaaataataaacttaggcttttatcttaggcttttcttcattatgcctaattagttacaatattaaaagcaaactggttagatttcttcttaaaactaccagttaaattggctaagtttagccaattatcatacatttataacataaaaatggtttcattaaaaaattttacattatacgaataatagtgtgctttatggtctcacaggagaattccagctcacattatttttagtaaatagtatgcatcaatctactttcacaattttccaacttgcctagtagagtctattttttcttaacaataatatttattttggttcgatgtttgaggtgatggatatcccaataacgctgatgtgatcattacacactgtatgcatgtattaaaatatcatatgtagcaccccaaatatgcacaagtatgatacatcaatttaaaaaagatttattttggtcatgtccaaattgtatgttataataattatagttcctaaatatgtagctataatctattttgcttgtgtttatggaggtaagtttctgggccttaacattcatttgaaggtggatttcaaaagtttaaaatatgtatcacaaatcctgaagcaatcacaaaaatagcaaaacgttatggctgatgattcaataaacacgattaaaatggaatcactgaaaatttgattaatctaaaagagtgcaaaaataggaataacaaaaatagatgtgacaaataggcactaaatagtaagatgataaatttaaatccaattacattaatactcccatcaaatataaattgtttaaatgctccacttgaaaagcagagatagactggacaaaagaagatcaaattatatgctgcatagaaggaatacttttcaaatattgagtacaaataggttaaaagtaaaaggatgaaaaaatactaaaaaatcatatgctaaggtagcattcataaaaagaaagctggagttaatcgatatctattaatatcacacaaaatagatttcagagcaaaaaatagtaccaggggtacagaagttcattttctaatgaaaaagggttgatttgatcaaaaggacattaaaaatctgtttatgtacatatcaacagagcttcaaaatacatcaagcaaacactgatataatggcaagaagagacaaatccataatgacagttgaaaatttccacattcctttctcagtaacagatagtacaagtagacagaaaatcagcaaagatatagaaaacctgagtaactctatcaaacgacacaaaaattttatgtaagtttcagattgagataatgaaataaaacacattaacaagaaaatgtctagtctataagaaaaattaaattactcacatatgaaatcacttttttacataaatggagacaaaaaagtatctcaacagtttaacggtttaaccataattttctttatgcttcttccctaaactaatctatataaagatttcactataatagacgtgctgtttactgaatcttacacatggataagtaaatactcatctgtcttaaaattaatttcaagcctgtataacttatgaagtttaaaaaaattcatcttatgaaacatacactgaatcagaatgcttactgtaaaaggtaaaagacaggaagtgaaatagttatttgcaataaatcatggcaaacacttgtctatagctcacaaaataagtttgaaaataattttacaaaatatctaatatttattcagtttaagacgtcattgattataaatcatgccattattttatgttcatctacgaaagaataagtgctctcaattaaattgtgatgtaagatacaccaatttctaagatgttaacatgtgaaatgtgcatgtgtcctgagatgttacatgggtgtgttctgagatgttaacatgtgactagatgtggcttttcaaatctaaagctaaaaacacatctcttctaaaataaattttgtgtgaactaaatgtagactgttgaatcacttaaacagccattacagccctagtgtttctggggaaatttataaattctctgccttgaatatttgaagaaagaaagatagtttcaacccctctgtcagttaataatgcaataaccataaggaagtaaaaggattacataacataaaaataattattaactcaaatatttaacatgtataaagcagtgttatattctcctccaaatccttcatctgagagtttttgttgatgtcttcagaaagctagcattccttgcacagtgactctaagcaacgaattaacttgatttcactaatccaactgaggccatatttaaacatctgatcccaattagtcattgataaggccttgagcactttcattctccagggtctcacagatactgaaaccaatagatactatgaaaagatgctcaaaatgctaaacattaaaaaagataaaaattgtatggcattgatttgtacagtgtgtgtgtatagaggtatgtatatataaaattcaaagtagatcataaatttaaaagaaaaataaaacaaacctatgaattaaaatacaatgaaggaaacggagcagaaaaacatctgagttttttgttgttgagctgtgtaatcaaaattgttctatttctaaaattcctacttgttacaataattaagaaaatataaatgtttaaaaataatttcattaatctttgaaatatttttctccaaagaacattttatctaacatcaggaatttattttaataatgaaaatgacagtggcatatattctagcaataactatttacatatgtattatgagaaactattcaagattctatcacctttataaactattaggtgaatcttagatagtcagatcttaggcaattaatagtatgaaaaatattatcagtaaagcaatttttttcctctaggttgcaccattgcataccagactgcaacccctttacagtactattctttaaagctttttatttaacatatattttcagtatatatggatactattttcagtacagatgtataagcagttaattcaatcaaacttgggtgtaatttgatcctccacttctgaactttataaaccgatttggctgacttaccttatcttttctttgcttttcatcctggtatacagtccagtgttctccatcattgctgtaagccagtttgtaggagccaacaaactgtacatgaccaaaatctttagctccttgtgtaatgatgccagtcactttggttggaacaagaagatccaccttaaaaaaaagaaaaatacaggctttaaatgcgacaaccaagttgtaaacttccaagtcttttgatgtcaagagaataaaactatatatatcctaaaatcaaaaatctgtctagttatttgtattttgaaaccaatgactgagtctattattggcttataattttgatattgccactgggttaatgtagtgcaagactccttgaacaaccatttttaccattttgaagtcaaatcatggtgatttcagtccaccaattaattttatattaggtggattcatctatttgtgcaggtttttttttttttttttgtaactgagatagaacagatgtggttggggtgaccttcttgagattgatcactacctgccagaactttacttatagttcaattttctgattttattggtcatttcaatgaaaataaaaatagcactgtagctgtgtccacatcagggacaaaaatagtattagattttcacaatggaacattagtcaatcctgtttccataaattttaatcaattcaataatatataattgagtaatagtaatcattgtccagtgaaaacccccttttagaaaattacaattctaaaatggttgaggaggaaggcaaatattcttcaaaaatgaagaaggattaaatatatgcattcctgacttgtagagtctatgctcataatgtgttcttttctgcaaaacacatactttaaagagcatgagacccatgaaaatttagtaagatttaaaatcatcaaaatgtaattgacatgcaaaagataggaaacattttcatcaagaatacgtaatatagaatagttcggtattttccctttttttctttaattcattcctgcattttttcacatcttatataatgttaattttttaaaaatctagaatactttgttttttatgcagacaactcttgtaagatctttgccttttatgtttatgttccttgatctacggcttcctctctcttcctgcaatagccacttacttccacctatttcctatgactaagtgccttgctacatccttgatcttatcatctttaactgtcatgatcccatgtgtgatcttggtgctttcaaccactatgtccttttgtttctatttcaggtcctctatcctgtgagatgtaaggtagccacaaatagatagtcatgggtcagatacaggccatgaatgagaagagagagctagagagaatgcatagaataaggccatatttagtgacacagatgcccatcagcaaaggtgtgaaacagtttccaatgtgtcacagcctgtgaatattcaatatttttgaattcacatgagctttttgttaactttttggagcatgtgttaaagcctttagactcaagttgcgtgatggattaggacaaaagaccacctttaatgctctatttaaacattttcaaaaatcaaattttttggctatttttctaaacatgtattatattatctaaaatgtcttgtgtgtccagcagtaatgcaggatggcaaaactatgatatcctgggaaggaaatggttgctgtctcacattgtgcaaatgttttcttctgggtcctcatttaatcctcccaataaccaaccaaggtaggatattaattccactttacagatgaataatttaatatcaagagatgtaacataatatggtgtgtgatccaaaaataaacagtgaatagagaaatatcacagattcaaatcaaaggtgcaccatagagattcttagcataacggatcagtcattgatttttgcagtaagtgattaccattgatcatttatattttctctcaatgatttctttccactctctgtgactccttcagaaatttctaaagcatcaccacactcgtcaaactgacagcaatttaagtcaaacaaaaacaatcctggattcatagtattagtaaagccctgtgttttatcatgaatttcttctctgttcttcagctgtctgggctttaaaatatagattgcttttgttgtcctaaatccaaacctaactgagcagagacagcagggcaaagctgctcttcttcaaagtgttcttaatgttgctggcactcaatacatggaaaaaaaagtcttaaagaacagagttggtgttttgctatcacaggcagtcaacatacaggaactcaaacagtgtcaccaagaatatgaaaacctccaggctgaatttcctcaggtcctaaacttctataagtccttagctaagatgatgcattgaggagttttctaacatccccttttctgcggtacttttaaaagtcagctgggtttcctgctgggtggagatgttttctccccaagttgtgtgtcttggcactttccaacagatacgtttttctcccactctaacggctccccttctgcaacattttttttttctatctagaaatgtttttcttttttgttccagttaagccaccttctccacttaaatagtcagcaatctgtttaaagctggattttgtcctaaaatttgcgacattaaacttagagtacgaggcctaagcaaaccttctttcagtacaaaaataatcagcaactcacactgaacatgaggttgctgacagagggcatgtatagaactcaccctgagaggcactcagaccacataactccagaattcgccatgtagaatgattctagaaaagcccattccttaggacctaattcttgaccctggtctaggaccgctctgccctcttgaagatcttcagggtgaaagttgagctgcaaatatgctggacaaaataccttctggtctttcagatcctcacctccccaaagtttggctaaaatagggcagactatttagggcactgagctggctcatgggtagacatttggcttcatgcactgcatgcacttcatgtctggatctgccttaaatgtgtcttatatataacaggtgctcaacaaacgttttgctgaattgagttgggactccttcttaagtatgttccatggacaagaaccagttcatggctatgaatgtcactatgtatcagagcagaaaattctagctacctttctctagtttttctatgaggatttttccttgacacagtgtcaaggaaacacagtgtcaatgtggtatccatcaatttatactgaagaaggcaagtagcaaaaaatcctctccaatcttaaggaatttgatgctaagagtcagcctactctaacggaactgggtggtttggggtaccaagttggttcaaggatcttggacatgctactttacctctctacctcccaacttcctgatctgagaaatgaggataacaattctcataggactttatgagaataagatgaggtaatatttatcgtgtgtacagaagtaggtatagcaatatataaacactatatagtaagtactatggaagactttggtaacatcatgaaattaagaaatctgagggaaaaatttaatatatgtttcagaatatcttgttagaaggaaatggatacagagaaatgggtgactagcttgttctagcaacaagttctggatcataaaatatttcgctcaccatctcaggatatatacaaaaatagttattttacctttacttaaagtagacaaattttgaaaaacctgaaattcccatttatgagtgaaatggttaactaaaaacaatgtaacgttctgggtatggtggctcacgcttgtaatcccagcactttgggaggccgagaggcagatggtttgagcttaggagttcaagaccagcctgggctacctggtaaaaccccacctctacaaaaattacaaaaactagctgggtgtggtggcatacacctgtagtcccagctacttgggaggttgaggtggcaggagggcttgagcctgggaggtggaggtttcagcaagctgagactgtgccactgtactccagcctgggcaacagagccagacatcatctcaaaataaataaaataaataaaacaacaaattttatatattatgcatctctattttaatactgattgtgatgcaatggagatatagctttaaagtaatattaaaagagaaaatagattccaaatcttattgagttacttatttcactctaagaatgaaaacaagagggaggatacttaaggagagaggattaaatgattcaacagtaaacaaaaaagtatggcatgagagttctgtgggaatataaacttttttgttgtaaaacatcctgtaatgttttggcaaagcataaatatttttagagtgtgtctaacttagacaaatggcatagaattctgtgagcatttgtttgaggaagttaaagataaacttcatttcagacatctgcacagcaccctgatcacagctccctggaagaagatggggcagactggaaaattaagttgattttcgtgaagacattcttgaaggggtgaggacaatgaaaagtgatacagataaataagtgtgcaagaaatgtgaacacaggccagtttcatcacagaattgtgccactcagctacatctaaaatgctcttgtttgtgccttcatatcatttattctgaattgtgtattttatgacttcatagagtttgtaaaattaactcattaaacggaaatgactttgaagctaatatggttaactagcacagtatttgaaaactgacttataggcaacgtatttaataacatttggtttcgatacagaatgttttatcttaacattacacaaaacaattgtagctagtcccagttatatttaaggcacataattaatggtacttggtatttggacaatattgctagttattagatgttggctacacttgtagtccatatttgcagggcaactagttaatgtgattaataatctgaaatattcagctcctgtatctgatttgatctagttctgatctaaagtttggaatccttaaaatatgattaaggccagataacataagcattctagcactcattattgcattttcccctttactaaaaaaattttaattttcaacaacattttaagacacttaacatagcaattgcttttttcatgtaatatattaaaaatacaataactaaaaccaaaaactcataccatgaaataatctgtcaaaggatgaagttttctgttgtattggtgtgttatggtatttttttcacatgtaaaaccatgtacgacacatgtatggtgcaataaacaaatgttctaagctcaagtgatcattcagctgtgagttttgtaggacacctggcatattgtagacattccaaatatacaggcatcatctgcctgaatacaaaattgagataattttgtacttaacaattacctgcaattacaacatgaacagtgccatatgtcaatctgaactacaacttatgattgttgtcagcttataactattaatttttaaaagaatttatttagaatcatgcaagtagttcaactgcacgtttttcactgagaatgggaggtaacatgataattatgaatattttatatttaacattttaaattttaattatctttttcattatgaataagatatatgatctgtagaaaaatttattattagaaaactttaaaaacaagtctgttaccatgagatataatcaatgctttccttcccaattcaaacatgttttcagacaaatttgttgttcttggcattttaaaaaatattattggttaccagacgttggttacacttttcatccatatttgcaggcaattagtttactctttatttcttaatatttcaatagtaattatgttattaaaatatttttatattgtctattttcaatatatatgtacttatttatacctagtatgtcattttaaggagttattacaatcattaacttactattaaacatttactccctctatcctcaatttttctattaaaattaacattcccacacaatcatagtcctttcatcctgggccacatatctcttcattcctacagcacaaattcaaataattaaggctacttggtcaaaggaaatgattttaaaaataaacaaaaaaggccttttaaacataaaagaaacatacaaataatagtaattcctaatgactatataacattccgtattgtgcgtgcatgaatgaatatgaaaatttttaaccaatcccttgttgatgttcatttaatttgtttccaattcttttactatcagaagaaaaacagactcaactctcatgtgtatttatttgcccactggtgcaactgtttccttatagacactaagaacctggcatttgaaatgtgatacacattgtttcatttatcttcaggaaaattacactcttccatctgctatataaaataactctttacacaccaatcccatttttaaataaaattttacatttaaatacattttattttttaaaaaattgatacataataattgtacatatttatgaggtatctagtgatgtttccatactgcaatgtctaatgatcagatcagggtaattatcatgtctatcatttcaaacatttattatttctttttgttcagaatcctccttgtaactatttgaaaccatataatatattacagtcaactatagtcatctgacagtggtatagaaaactagaaattatttctcctatctagctgtaatcttatttcctttatcaaatctctacctaacttcccatgccctctaacttcccagtctgtagtatcctctgttctactttttacttctatgagatcaactttttttagcttctacacaagtgagaacacgtgtgcttaactttctgtatatttttgacaattgaaaagtggcatttttacctttaatctacataaatgtcactaagtggcatttaatttatattttcttaattgttcagtgtcactaattatatatatatatatatatatatatagtctctttcatgttctttgtctattacctattggattagaaatgttcctgctgatttttaagaattatttatatagtatcatatgtggtttctgttatatttgttgcattttttttctaatttgctatgtcacttaattttatttttagcacaagttttcaattttactatactcaaatgtatcaattactgttttcatgattgcatatttttgtatggctaaaaagataatttacttgattagatcagttaaatctacaattttctctgagttttcctttcaagttttattttattctttcttgcccttactgaaccatcttggttttatgtgtatacataatgtgacataggatcacagtatatatatatatatatatatatatatatatatatatatatttaagaacataattttttcaacactatttgttttataatctatttcttctttgttctatccccctacctgagtgattcttacaaggtttgcactttcttctagaaattaatagtattaatcatcatcatccaccagtatatatcttgataaaggtttcttgtattgctttggacagaacaaagttggtgcattcaagctgcagactgttttctaggagaagacatgctcaaaaggttttcttgagttatattttaaaatattgcttctgcttctttttggtgtctcattctagaaggccagttgtccaaaagctgagtttttatttctgaggtttttttttgtaatattttctcactcatccttttcatttatttattattttcctctgcattctcagagagtttctccattctgtccttaatattatagatttatttttggtaatgcaattttaacatatattttaatctatattttgaaatatatttcagggaaattggaaaaatatagcacctctcttattttctcagcattaatcttaccttctctattactcctctattatgtcataaagaaaaaaatatccttttttcttttttttttttttaaagagacagggccttgctctgtcacccaagttagagtgaagtgcatgatcataggtcattgcagcctcaaactcctaggctcaagccatcctcttgtctcagcctcctgagtagctaggggcatgcacctccatgcctggttaaccttttattttttgcagaaagtgccttgctattttgtccaggttggtgttgaactcctgacctcaagcaatcctccacccttagcctccaaaaatatttttatatatgctcttgaaatttggttgttttttttatccgtagaatatttcccacttaaaatttttttttcatacatttagaaaaatccctattcttttcttgttctgcacatttaaaaaataggacctatattatcttgttttcccttcctttacttaacttgaaatgacagagaagagtcctggtgtttgtcacatgccagtcatataagctcctctttgtcccttaccatctatcaagcagttgcaagaatttcttagactttctaccaatgcccagcagacatttaggcagtacagtttatctggtctaaagcacaagactctcctcctcttgctgttttcctctgaatatagaaaagttatttattttcttaataatccaaaatccaaagctttctgttattttttattcaatggagattttgctgagataactgaacatccattgtttatttctctattatataatttatgtattatcacaatgttgtcaatcttctcttgtcaaaatgtaaaatcacaggggcagacaacttggtctatgttatttggcatgtgcctggcctatatgtttcatgaaatatctactgaatgaacagtttcatattttaggattaagtaagctaatgcatccaatgtgtattctattcatctttgtcacatttgtattactgaaggtttactctgtctgcaaatgggaatggtggggtgttaggaagtcaagtactgactacagcaagatgtttctggttgtggcaacatgaccactgagcctctagcctgctgtgcaggctctgagtcttggccactgctgccctgattcagatgtcacagttcacacactgtagtgacaggaagacactgcccagagactgcaaagttaccaacaggcatcccaatgcacataaatttgtgcccatcatcaacaggatgatgggaagggaatgaaagcctgcagcagtcatgactcataagtggaatgagtaaaataatgtatgtgatttactcataaccataatacaggaacactaaaaatcaggtatactttatcagctccagggaaactttccaaatatagttgtcagcagtgtttgaaaaaactcaaccaggcttcactaagactccatgtatacgaatgaaagtccatccatcaagatctcattaaatttcaagtgagtttaaaagataaaaacagccaaaattataaaccttattaacaagcacatttggagttaataaaatgatattataaagattaaatataatgttcttgtattaagtcatgacatattttttaaaacttgaatttctgtcttttaaaatgagcagatctttataatatcctgtatgcattttattttgaaattgttctgaaaaaataattctcaaataattttagttataagtaactaaaattgacatcaagttaggctaattatccaatttcttcaagacctgtgtcagagagattaaagcatatttgaagaaaaatataaaacattggaaagttttaggaaaaagaatcacccttttcttactggattactgaaagtgactttctgctgagttcatcaaaaataaaatcaccctgggtgagcagaattaacatatcttccttatttgcctttcaagcctgattttgattagtctggggactttgacttattacatgaataaaaaattcagggtggtggttaattgaattagtctataattgatagggtcattattaattgattaatggagatttaatacaagtttttgatcaaagagcataatgatatccaataaagatttttcaggtactttaattacagcagtgactgcacaaataaagtagaaaacacagacaattatcagtaaataatttgcatgtgatttagaaaacaattacatacttttaagtaggacctgaaagagtttgttatttagtattttttgatagcacagtgtgaacgttgtataggtcagcattgtgtcaggatcttttggatagctaaagactcagtgagctggtgatcagacttgcaggtacttcaagtagctacaatttagttgattgtttacacgtgtaaaaactatctgaatatatctttgacaattactttactgaatataattttatgcaaagtgttgtattatgtaaagccattatataaagactggtgtttccaaacacaaaacatctatatacaaatttgtgtgtcaatatgtagaactacatgcatcttattctgtggcaaataccataagaactgaaaatataggttggtgcaaaagtaattgtggttttgaccattaaaagtaattggaaaaaccacaattacttttggaccaacttaataaaacatccgcagagtaaagtatattgtaatagcaaatcacattgcataactaagtattaggaggtccttgaaagtttggaaaactgacagaacacacaatgtatttttgtgctttgtgcttgctggaggagctatgcattttatgttgatataaaatttaaccattcttacaatttgtaaatcgtccacagagtcctttacatcattttgtttcatcagaccatgtgagcctgaattctagatttttttagtcttagttgggtatgtgcatgttttatggtgattgctttttaggctaaaacaaaaacaacaatccaaagaaacccagatgtaacttttttccctttgaccttatcaaaggaagtggaaggggcatggcctcttagaaatcaagcagaaggtaaatgcttcaaatcgctttgggaaaatgtgccatcaacgttagcagtcgaaaaacagcccaggtcagcagagagtttggaaaagattggaggggagagaagagggagatgactcagcaggaacagaattgcctgcggattctggggttaagagccactgacacagaaagtggactgccccaaaggatgacaattaaaaaaaaaatttttttgttcaaagatcagagtatacatatagtaggaataaaagggatacgaattatttccattcaaatgcatggtccgtaacactgtgagcattatatttgtataacaagggcaaagagcctccagcagatctggcagggctatctagttcctcagcatttcagtcaccataaattatacttgtagtcttagagagcctcattaaaagtcatgattatagactttctcactgaatacccataaaatcaacatgttttatctactcatatttatattaatttatttattgtgtatatatatcttatgtatattcttcttctgttattgatgctaatttccatttgctttgttctctgtagaaataaggagcagctgttgtattcttaaaactccaatctcatcaatcttttcctttaggtcctaatatctatttccttaatatagttaccaaggtcttttgagcttaataaatggtaaagtatagaaccagatgttgaatgctgataaaatctgaatatgatttaatgagtatattttaattaagtcctacagtacgatgtggcctgagtatttctatgatgaagcccaaaaaacatatatggctatagttataaagttctggcttgaatgtaaggtatataactttcataaaatattttgttcttgactgcatgtgagcaataagatgcttagactttacttcttttgagaaatggcctacatttaagggactcatatatatgcctctctcagaaattacacaagggctaatttctttctgcactcagcaccaaataaccttatattttaaaaatcacagtcttaagctctaaaactattcatgcactgtactttctattactataaaatagctcataaaccacaatcttaaattaggtatagaattaataaatcacttgaaacaaactcattatattaaacttatttttttgcatatgtattcaagattttaaaaacttctcaagttatagttcacttaactgaggactcatttgtagatttaaataaagaattttataagacacctccatctgttgaacattttttacataactgtctttgatatttgatggaaggcttcaggctcaaagctgctgacattttaaacataatttgaaaaaaatcagatgtgacatcaacaggaaatagatgtataattccttttttatatattataagtgtttaaggatcctgaattccaaagatatttttaatgaagttgaaacactgttttaaacaaaagaggaatcttgtaaaaattattagaatgacactaaaagtataatatcagaaaattaacttacagtggaaacaatcaacatggaggcatcagaacaaaaacaaataaaaaaactatcctcataaacaactcaccagatacgtctcaagcttctggcttattgtattaaaagaggttattttgacatgcctttccaattatgaataaatctgttacatttcaagaaatgctaaaatatctattaccttaggaattagaatataagctatgacataaaatttatgttaaacagaatcactataggcccaacacaaatgactcctgaaagtcttcctaagacactaagaacagaggtcacacacatatatatttatactgccagattaatactctgtattttgaaaaacatggccttgtgttgggatgcattgcttccaactcttttgtagagtagcattttctttaaaaagtaacagacaatgacataagttgtcatgttgacaatatgcttcaggaacgagaaatatccttgttgtttgggagattgaaaggtaaactgtcaagactaattctgaaataacactttttttctggaaagctttcatgtcaaacaactaatgtgctgtattttcaagagggaaataataataacaattcattaatacagcccaggcattaatgaatgtgtcaaacatttgtacactgagaatgctttttgccatagactttttagcagacacattttattaaatcaagaactttccctaatctatttatttgcaatgaaaattttaaatcatgaatgactctatcagattctatgaaattatatctcttttcatattaagataatcatgcaggtttcttttttaattaattaatacaaaaccatcacccaaccaacccgagaactgtgacatcgacaatacctatgttaaccctgtttagcctgtcctttacttctccccaccaagtatactcaatcctaaattgtttattgtgcccttgctttttaaaatataattttataattatgaatgtactcctaaataataatatttagtcttgtcataaaatttataaagaatttcatacaggaatcttctggaacttgtttctaaaactcaatattatattactaaggttcaactaaatgtttgtttataaagttactttatttttactgcaccataacattccatatatgcataaatgacaatatatttatctcttctcctgtcattagtatttgattgtttccagtttttggcttttaaaatcagtgtgaggaacgttcttatacttatcgcttggtaaagatactcaaaatttttacttgaaaatatatctaggagtaagatgtttttggttgatgagtatacgaatgtttaactttacaagataagaacaattttcaaatatggttttgccaatttgtgctaccaccatcaagatatctacatccttcagctttaatttcctaacttggtgattaccattagaagatttttttcaagtgaaaacattttatgcatttctgaaataaattttcctttactagaaaacatatttaaatgttgatgtattctatttgctaatattctattaaagacttctacatcattgttcacaaggaagattctcaatcaattttttttcttgtactctctttatccacttttggtgccaggaagtcatggtttaacaaaagaatttgcgaagcttcactctctgtcttctgtggagtagtttgtgtaacacagagaatatatgttttctgaaagctataaagtctaattcaatatctttaattataagtctattcaagattccttttctttttcccttgctttttctcttgaacatatatatgggttttcaacttctctgagtaagttttggtaatgtttcttttactataacaatttttactacattttaaatgcattggcataaagatgtttatattaaattttttctacttagtccatatttcagcctactttttcatagtgaatattttttctttctttattctcttggataattttgtcaacattttaaccatttcattagttttcttcaaagaaccaccttctaaacctagaaataaaaggcgatttcttttaatgaataacagatttcctattcacttttacagcaaaattaaatgcagggtgaaattctggaagaatctccttcaaatcagatagcaggtatcatgttccaacaacctcttgtcttaaacgctatactgaagactttatataaaacaataacaagagaaaagaaataagcatataaaatgaaataggagatacaaaattgctgctgtaagcatatgatataatagaaaaggaaaagactacaaacacactttacaatgaataagatagtttagcaaggttagttgatacaagattgttattggaaatctgtaacatttctatccactaggctcatccaaatagaaaatgtaaattttagaaacccattcactacaacgacaaatgtttttatggtattacagaatgggcatctacacagagattgaagtccttaataaaaaacaattttaacacctttgaataactcaacagaatacctaaataaatgaaaagatataacatatgtcataaatgagaagcctcaatgtaaaaaagatatcaatttactctaaaagtcagcacatttaaaaacaaaattccttcagaattttggagaaatgtgctaaactgatttgaaaatctatgtgaaaaaatgagggaccaggaaaaacctagataatttgctgcatggctagtggtggtaatagggtgaggtactattgccgcctaagattaacccttaaaataagtaaagctatacaattaaacagtgatactgttataaggatagacaagcagaaaatcataacaaaacaaagacagaaacagggtcatctgaaagcttggtatggattggaaatgagaacaacccaacggaagttggactcaataaaagatgctacagaaattggctgtttatacagaaaatgagtccttcttttcacagtatcccaaattaaatccccataggctaaatctcttaaatgtaaaaagtgaaacttcaagtatttcaggagaaaatatgaaagctagcatttgtgacatgaagtagaaagtaatttttaagcaaaacataaaaatgacacattttactatattaaaatgaaaatttccatacaactaaaacatagtaaacaaaatcaaaagaaaacatagagtctgagagaagatattcttacaaaagtcctaagaactatgataaattgttacaaaggcaaacaaacccatagaaaaattacagacaagagagacataggtaactcagagagtctgaaactctttgtaggatgagacataaatgaaaagatgagaagtttcattagtaatcacggaaatacaaattacaacagcacttagattctatttcacatcccaaacttaaaagttcaacaatactaagtgttaggtgctggcgagtagatagagcaagaataactcccaggcactgctgatgaaaatccaaattggcttaacaacttcgtaggacaaattaataatatttagtgacattgaaaatgtacacagccattgattcaggaattgcactcctagacatatttctgagataaattatcacaaggagacatatataataaacttatctgtagcattactgttttagcaaataattatgaaaagttataaagtctatgaacagaattgataactaaatgggattaaaatgggaatacaatagaattatatgtatcaacttggaaaaatctcaaaaatatattattgaacaaatatgaaaacattaatataaatgagataatacattgcagatgaatatgaacgtttatattttttaactttaaggtagcatagaaaggtacccatggtagctgcatagacattgccatcattacctttttcttctgacacagccaccaactgtcccaggacctcctggaatgaaggctagggtgaggtctagattggacatataggggctctattgcctcaatttgactcttcggaggtcaagaattctcttaccatttatgattctaatgaatacatgaaccataggttcctatgcagtagccctaatgggccgggtaacacagctcagaaatttgatgacatcaatgtcttgtagggcagactctgatcactgagaaaagaaattggaaaaaacctaatagataacattctgctcccttcccacctctcactgtaaccaataacatcaatgcacaatgaaactcttgagaccctctggagactctgagcaactcagcacctatgttttctggtgaaactgtagttagttcaattacttacaaacattttacctattttcctttctttagttctgcgttcttgctgtcctgagattgtaccatctaaaagtgtcagcttaacttgaggtgtgtgttttttttttgtttttgttttttatgggccctttggctgaaacaaccatttatagagtattgtttattatttactataaaacggcaacagaagctaaggcaattaggtaagaaaattaaataaaaggtatctggattggaaaaaagtaaatctatctttattcagatggcatgatcttgtatatagaaaatccctgtaatcccagtactttgggaggctgagatgagcagatcacaaggccaagagatcaagaccatcctggccaacatggtgaaactctgtctctaaaaatacaaaaattagctgggcctggtggcgcacacttgcagtcccagctactcgggagtctgaggcagaacaattgcttgaacctgggaggcggaggttaaagtgagctgagattgcgccactgcactgaagcctggtgaaagattgaaatatatatatatatatatatatttatatataataaatacataaataaaaattaataaaaaagaaaatcccaaagaatccactaagaaatattagaactaataaacaaattcaatgagtttgtaggaaacaagatcactatataaaagtcaactggttttctatatcctagtgatgaacgatctaaaaatgaaattaagaaaacaattctacttacagtaccactaaaaagaataaaatatgtgaggataaattcaacaaaggaaatgcaagactcatacagtaaaaactacaaaacattgttgaaagaaattaaggaagacaaataaatgaaaagatatctcatggttatggatcggaagacttagtattgttaaatggcaatactctccaaattgatctacaggttcaacatatccctaacaaaatctcaactggcttctttgcagaagctgacaaactgatcctgaaattcatatggaaattcaagaggccccaaatagccaaaacaatctcaagaaaactccacaaagtttgaggattcctactttttaatttcaaaactcactaggaagctagaaaaatcaacacactgtggtactggcatttaaatataaatatatgtgtatgtacatatgtatgtacatgtgtatacatacttggaaataagtatgtatttgaactaaaaatgggataatgttaacttttgttaaatttgagtattatatcattctctgtgtatgattacaatatttttgtaatttaataaaacagtatattgtgaactccagggatggaatgaaataatctttgtatttgtttttgcttcttaaatattcagtaggggtgaggaaggatagagtattttaaggtgtcagcctaaatttttccagttaacactgacactatatatttagtttttgtgtatgactcaaaaacactaaatccgtgaatgcaaagtaaccgatgattagccaacttctgaatatttttaaacaattctgctaccccagagtattgtaactttaggtcaagcagaaactaataacaggactgtttaaaatcaaatatctttatttttactttttgtatttcacatgacctctttttattatcattttttattattactacagccatataactaacattaagtcattcattttaaagaagactttgccatctgctagccgaattcattttgtattacttgttttcaaatttctacatttctgctgcatctggcacaaaataaatatggcaaaaaaacatgaaataacaatttaagctacaatatttcataatttatataacaaaattaggttttccaaaatggcagatagacctgctccggtatagaaactatatataattaagttatctcccatcaatgctatcatgttcttaagttttaccaaaaaaaatctaacacatgtgatttaaagatttcttaaaactatgaataacagtatcaaaatttgatgaaactaattaaaaaatatttattggcttcccaatatgttcttccactccctcccagcttttcttatatggcataatgcctaggtcagagctagatcttcaacaaattttattttgctcttatttttccattactgaatgaggccaaaattaatatatcaattaataacttaaaattaatagatctatatttcatattaatttgaaactcaaatgtaagggctctaagcatttcattaaatagcctctttctatttcctcaattattccatggcaaatctctccaatttctcctcccaggctttcctgaatactcctgtctttgttgagaattttggctgttgtctgtaaatatttcctcctttttctgagatttctaactcatatttaagggcatagcatgaggatcacatatttttgtaactccttccctggcattctctttgtagtagagttgacttctttttatatctctagaataagattaatagtaatttcgtgtataataataattttattgagtgcttattcatcactaggaagtgaaataagtattcacatgatttatctactcatcctctgagttagtttctattactgtacagtgttacaattcagggagcctcaaagaagctatgtgactttttcaagggcttgtaggtgacagaataaagattttccactcaatctatctgatgcatgtttggccactgtgctgaattgttcaggttggaccctacaaaagggctcctggtagatggggcacaagtggaagccaagcctcagtctgtattctgtttcccaaattgtacactcttgagtggctgcaacagcagcccggaggaaagagattcatttttctcatgggtctcccccagtggaggtacttttttgtaacttatttgctcgagtgaaaagcctttttataattgctttgaaggaaccatatgaactagtatgggttttagtcaggttctagaacctttgctcccaacgatcagtttatagtctctttagtatatccttccactatagtacgtatcgcattgggtttgcagtaatctgtttacaaatgcttgtccgctgctagatttcgtgctccttgagtgctccaatcatgtttctgtaatctttgcatttttaaaacttactgcaaagtctgtgtatattaggtattgaggaacatgcttattaattagataggtcgacggatgaaatgaaagagattggatcaggaacagaagttgaagtttgtttttaaaatatagcaagatcaatttttcttcataaacagcaaggaaaaattacgtgtaaatagccaaagaaatgtttgagtgaagaaaaagatctcttgagaccaaagttttaaggtggagtattaagaacttcatgttatactccatggcactgtgaatttggcagcattgtgcaatacaaactttgtcaggaaaagataaaacttaatgagaatgactttaatgccttttcagtaatgcacaatgggggaaaggtccccagattcaaagagtagtaatgagaaccaaaaactcagggacaatctgacaggtgggaggacagggactttctttttttttttttttttcactgttcattcaatctgagtttaaatcaagataaagagcatggaagtgacagccaatggcagcatacaggaataggaatgggttaacacagccaggtaagaaatggatagataaggatctaggggcaagtagaggaaactagtagaatataaagtctgatgccaatttgccaagtaagcgtcagaatcaggagactaagaaggggtatagattagattctcttgctagggctggaaaggtagtctatgcaaatctgaactcagcattgacttaagaggccaggacagaggaacaatggacacagggtaagaaagggaggctaagtcagggcagttggttcagagcgtcttgggaaacaggaagttaagaatgtctgattaaatttcagggacccaagagtgaaaaaagtcagaagagatgctacggaaagttgcagaaatgagacaagtcgagcaaggcatactatatggagtatgtgtaaaatagaatacagtgtgtgtgaaagtgaggttgtgggatagggaatataaggggttctggaaatatctggcaaaaaacaacaggtaaagctctaagtacacagactctctatatcatagagcagagacctgggcataagagtatgtcttgccagtagttggattcttttctcagcaaacactggtgaggttaaatttgggaaatggtggaatatcatccggggaatcaactggaaaaccaagtaggattgtggtccaaagaaacaaatcaatagtgcagcaattaaaagctacatacggtgacaaagagaaacagcagttctaataatgcttggctcagagtttatatggcagggctttaaatgtccactgtctaggactctgggaggtgaacctgaaagtatgcatgaagtaccctcagcattggagctggaagtttgcagagcaggaagccaggcagatcattatgttgaattctatctatgtgaaccaagatctgagggtcccgaaagacagggtgcacgggatgtcgtctgcttcaccactgttcctggcataaaatacaatccattcacactcagctctgcctaggacagcttaggtgttttgttgaaggagagggggaatgcagagcttactttcatgtataatacattatagcattaagccaggtatgctacatgcatgcacacacacgtatgcaaacatacaccacacacacacacacacacacacacaccccataaacatgcacgctgaacaagcatgatatgatttctacaatttttaaatttcctcgattctcttttcaaacactccctggattccttctttttcccattccagcctaaataaaaggaaaaatgtaggagaatggagaagactttttctgcttggtgcctctagattctttttcatgctaatcgtatgctatatttccttgcaaattgattacaccagaggaaaaaaatcacaaataagtataattaaaactgctcatgatcaatatgaggcattgcactagatttctgttctagcataatgatttctctagtttagcaagtcttggtgaggcataactgctggaaaaaaaatgtatatttttgtatcaaattttgtttggacaaatttttttaaagactctaattcttttctttgctcttgcttataaatatgaagtgtttacacttaatattttttggtgacagaatttaattgaattgaattgtggtgtctgtatgttggtgcagtgcttggaaagctgtgggaaatgggtgctgtttgtatactagagtaacaaatagggccaaacaccctctgttctaaaatttcttgcttatctctgttcctgaaatcaaatttgggtacaaagaagaaaaattcacaacttacctttgtaaaataagtaaattggccttgattttatgtctgtctgaactctcttgttgattgttttattcattttgcctagcaccagctatactaggtaaaattatttttaataggtaaaatatataattacctatatataattttaataggtaaaatataaaataataggtaaaaatatttttaaattcactatttttatttacacaattttaaatctgcttttcatagttgtgtgaataggtttgtattgttatttcatatatcaagttccaacttgctttgggtcattctgatgttggaattcatgcattttttactttaaaggtttacagtgaaacataaaatttcctattacgaagtacagggctgcaatgtagaacacaaaaataaaacctgaaaaacaaggttaattcttactgggaaaagtgaaggagtggttaaatatcttgatttagaaataagcatgtatacaaagtgttcagcaccactttttttaatctaataaataaaaaggatataattaacaaaccacttcaacaataaaagttaaagcaatagctagtttaaaagagcgcagtcatcaagcaatccccaatacttgcaaaatttcttaaactcttgcatattgataaaattccaaataaccaagatgtagtttatattaccaagtgtcttccatcatatgctttatggtgtagaactaaaactagcagatatagatataaacttgaatttgttatgcattagcttggtgaccttaaattaactaactttcctgaacttcagttctaaaatgagaggcattacttagaagagttttgaggctcttttccatttgaaaatcttggcacttcattatgctgcatgttaattggtagcaactatctctgtttactccgtttttatactgtatttatccaagcatcaatccaatatttattgagtgtctactctgtgctaggcactcgggttactaaaattcccttgtggggtctgagtatagtgggacaagcagacttgtgtatatatatattgtagcacagaggtgggtcccctgcaggcgtaagaacaaaatacctgtagaagggacagccagcagagtccaggtgaacctgaacattgaaggattagtaggagttagacagtggagaaaagaggaaagggcattctagaccaggagaagtgcacttgcaaatgtgaaatatcttgaaggggctttatggtttggaaaaggagaatttccatgtggctggagcacacaagagaataaccatgggagcaggaggctggaatggaaggtttgagtgaatttgggaagggactttcttagtaacgagccatgatcaggaagctaagaaagttacagtctaaggaatggagattttaacttaaatgtgccatattaaaaataaaggtaattaggttttcaccatgtactccacttgagcaaatcctttaacctctctggactttaggttctctgtaaaatgtgatcattagactttcccaggccttccctctagcaccatgcttctgtttttcagtcttcttatgtttatctctaaaactgcagtttctggttataaattgctgtgcaggctactccatttgcaaatagcttggtttctccttgtttcaacctcaaataacataaaagtctattaccaatacataatttgtgagtctgaaagaatgcattctggtaacattttataactttttaaaaagtggcatgccttcatatggtataatgtaaatttaaatattttgatttagccagactaccaaatagtgttctatctttaatttctggtgacattagtatgctgactttttaatgtttactatttgtcaaaatatgtagccaatttttcaccagcaggagaaatctcctacatcaccttttaggtgtgctagaaaatgcagctgctaaaaatcaattttccatttctgaaaagtgcagatccttgtgtatctgcggcttatatttcaaacagcatttgctgcttacagcttaatcttttaaatggtcactgcaactttgcctcattatccatatatatgtccattatatgcagactcatcatttgtgtccaaacctctgtatctttgctatagtctctgaggaggtatagttacatattcaacagagactgagaaagataatgtaaaaattctttttcacatttctttgggttagaaaatcattttgcagctgatagggtgtgtgtgtgtatgtatatatatatatatatatatatagcttaatagtttatttttagaagtctcaacattagttattatatcaatcaatgtctactagaaagcaaaatggaacctgagctgaggcatccaacgggagtacagttaatgtctcttagatatggaatcgttttctgactacacaggatgtacttgtctgtacttgccttttcccattgcaaataaccttccatttcaaatccacactaaaattgatcataaaggtagctttgtaagttctttctcataacataacgtgaaaagtaacttgacagcattaaggcagccaaaatcaacacatctgtgtgctgacatttcaagtgatttatgtgcttatcagactgctcaatacaataatgcataattacaaaatctactgacacataaaagaaaactaatcatacttttgtgattcaggcaacttctttttgaaagacaaatgcaagtcagttttatatttattaaatgtaaatacattttcatttgaaattttaaaaataattaaaattttgcttccataagtgctagaggaaaacagtcctcctttcatgcttttctctatatttggtgtttgtcccattttgcacaaagctcatctgttctagccaggaatggagtggaagagctctctctgtagagctggcacaggtagattcaatggtttcttagtcatttattgcctgggtattcctggaaaatcctgtgccctctctgagctgtttcttctactgtaaagtagccttcataacaactgcccctgacctccttatacaactgcttgcagtgtcaaatgagagcggtatgaaaatacttctgtacaggtgaaatgctacactaaaatatattttaaattaattttcctttatatctagtcaaaacatgtttgttcctaaagagcaacataagccaagtctcctggaaataaaatgataccattacaaatctcaatacaaaaatgcaataaagagtaataagccgttatataatggccaataaggataacatttctcagtcccagaccaagaacaagtaccactacttgtagaattgctcaacctttcagttctttaacactctgaaaagtagtatttttacaccattgaaagatgatttttaaggaaaaacaaaatcaaatattaagttttttgttggcaaagttataaagtaaatttctgattgtttactttagctttcatgtagttcaggataattgaataaatccctagaagtggaatcatggttcctcagaaatgtaaactctgggaactaagcctatggcaaaatataattcctgcttcattttaataaatgctgaacaaagagaaatagccactcctccctatctgctcttccatgtaaaagaaaagattcatcccattagataaaggtctggaatctccctgatgtcttattgtcccctgcccccacccccatgagctaaggctacttctcttcccaatgtccaaatgtgaggctttgctatcagtgctacacaacagagaaggctcccagatagcagagatagtttgtccaggagaatgttgtgattttcgctttgctggttctgtctcaaaatatgcattgctccttatctcctgggaagtgaatatggagtatccctgatggttcctttgggtctttgtagaatgcatcatttgaatgaaaggggacaaagactgaggagaatacaggatggctaaagggataagtaaatattgtaagagatatttgactaaagtatggactttaggtgtggtggacagagattgaggtggctcccatgatctccacttgcctggtattctcgtacttgtatattcgcctttcctgaatgcaggtgagacctgtgatttgcttctaaccaacagggaatagcaaagattagagatgtcattcccttgatcatgttattaagcctccatctgagcagactggagctagagtttctcctagctggcttgatacagtcagtgaccatgttgagaagctacatggcaaagaactgtgagtgacctctaggtcttgaggggtagcatccagctggcaactagcaaaagggctgggctgctctcacacagaaacaaataaataaattttgccaacacttgaatgtgcttggaagcagatttttccctgtgcaatcttccagatgagaatacagcccagtcaacaacttaattgcaaccttctgaggccctgagcagagaacccaataaagccaggtctggactcctgagtcacagaaactgtgatacataggtattcttttaatttgtaataatttgttatgcagcattagaaaactaacaaaccggccaggcacagtggctcatgaccataatcccagcactttgggaggccaaggcaggcagatcacaaagtcaaaagattgagaccattttggccaacctggtgaaatcccgtctctactgaaaatataaaaattagctgggcgtggtggcatgcgcctgtaatcccagctacttgggaggctgaggcagaagaatcacttgaacctgggaggtggaggttgcagtgagccgagattgggccactgcactccagtctgccgaccgagtgagactccatcacaaaaaaaaaaaaaaagaaagaaaagaaacctaacaaaccagattacaagtggaagtcagaaagaagacttggtgaaatgattatcagtaacagagaggtaaagaaaatgggttggccgggcacggtggctcacgcctgtaatcccagcattttgggaggctgaggtgggtggattaattgaggtcaggagttcgagaccagcctgcccaacatggtgaaacccatctctactgaaaatacgaaaattagctgggcatggtagcgggcacctgtaatctcagctactcaggaggctgaaacaggagaattgcttgaacccgagaggtggaggttgcagtgagatgagattgcaccactgcactccagcctgggcaacagagaaagactctgtctcaataaataaataaataaataaataaataaataaataaataaataaataaaataaaagagttaagtgcagagcacagggcaacatgaggaatggatagtgtaagagtttttgcattatttacaaaatgtaaaggactgtatttgtcaatgaaaggtgaagcacactgctgtacagcaatatctttagggtacaaagtaatttcaagttatgctgtactttttagatcctgaaacttttcttcctattaaacatgtatattctttgcttcttaactgtttatccctgtactgcatgtttcattttcacagctttgtttagaatccctacatcaactggcccgttcccacatcttttccttacctggttgaactgcaagaaactctttttttccaacaacataaatagtaagatctgacattgtaaaagtcctcttttataaagaggaagcatataatgaaatagttaaatcttttttaattagaataagctagatgtactttctggtaaccaatcactctatcttactgattctgcctcatcgattcaccatctacttccaaacttcatccaacaacatgttttctttctatgatcacacctcttactttctcacttttattcaattccacatgaactttttgaaagttaacacattcatttcctcaacactgtacccacaatcttactcgctaggccattcattgcaaattagtcttggccataatttaagcagcatagagaacatagtaagtatcgtggcgacttggtactgatggcattggggagccaggggaaacattgtggttgtatgtaatcactcaccattagaaagagcatcttttaggttttggcaggatgttgacatatccatggactacatgccacccttatcacaggccgaccgcggaatttccttcctaccgtttttcctcctgctaccttggtgagaggcacctatctccctaaagctcccctggcagaatgtgaatatactcagatcctctgtcttgatgaacctatttgccgtctacgtttggtagatttgtggattcagataatttcaatgttatgccctggaatcaatcagttggccactggaggtttcaaacctcagtatgtgctgcacatactgatgtggttagatattcttcttaaattctaaaccagtggtattcaagaatgccttagttatggcccatttttgtaaacatacatcatcttccagtgattcaatcatgcaagaacaatagtggatattaagagctattgtcactgtgctacatttccaggtggaattcccacaatggactataaaaccacttaaaggtagacagtgtaactctattgtagttcataatggtgaagaattgaaagagtataacaattgtgttcaaaagtctatttcatgaactctttagattaaaaatctatgttcaatccacagacaacaataaagaaaatactgatccagcaattatcaggttgatttagacaatatacttcatggatctttgtaactaaaactaaatactcccttaattttcaaaagcagctatataatacatggcctactacaattacgtcaatgaatggttcaaaatattgctgtatagatactaattaacaaagcagcgaggaagagaagaaggcaagcaaataaacagttggaaacaaaatctttacaagcaccaatggtttaaattatgcttattatcatattattaaaattgtgttcatagtcaattccagctttaagttaccgtatcagtgaaaacactgagatatttacaatgagatatctgcatatatttcaatatttcactatttcaaactaatcacagcacgaagtaatgaaagacattttatgtaaatctattaattttaatgttatagaaatatcattgtaaactagtatattattataatgtattatagtctgagagttatggccatagagttatttttatatactctatttaaaaatattaaaaatatttttaaatctttttattaattaaagactttagttttatcttctggataagtaatatgaagctacaatgttttaaatttttggttcagatttagtgcctatccaagatactgctgaagtacctgcggaagtacaagttgctattgaggaagattcaacttacctaaataagagaaaatcttaaaatagtcaatacgaaacattagaataaataattccagcaaggaaggaataaaagagcctaattagtaataaactgcactttaaacaaaaccttaattattgtaaggcaatatttctttattttatttatttattgagacagggtcttgctctgtcatccaggatagtgtacagttgcccaaacacagctcactgcaccctcgacctcctcggctcagttgatcatcctacctcagcctcctgagtagctgggattacagacaaaagccactgtgcctggccaaggcaatatttcttgactttataaaaggcatgctccctttgttgaatatagagattgtacacccttcatattatttagaaatgtaaataaatctcatgacttaaaaaatcaaagtatttgacaaagtgatattttatttataaaccacacatattttcttccattctccattaaaataagaagcccttggggtgcaccatattccctatctgcatccttacctttgctctataaatgacagcctttaatcacatcaaggaaagattgaatagaattttagagaatagctactgaatctcttggtctccctaccacaagatacccttcttaaattctaaaccggtggtatttgagaatgctttagttatggcctgtttttgtaaacacagatcatcttccaaggaatttaaatgtgtaaaatagtgagagctgaccactcagactgactgataagggagtgagtgtgttccaaattcatttgttgagtcttcctctctgccctccctagcacccactctgtatacccaggtcttccaaggcaatcctaagcctctgagaaatataactgggaaacaaccaatttaaaatatgttaccaattctactgttgcttatattacacccaccttcttatcctgcttcattttttggccactgtggtccctaatgctttccacaactatgtgcagtgctcttaaggggaatgtcttagtagtatgctccaacatggttatgttaaacggtcattgaaaaccttgcaattgtttatatttctccattgtttttgtgtacataggcattttacgcttcctttatgatgcaaacagttctaagatcctcccataaagctagggttatgaaacttaatttataaggtactttcagataactatactctgtttcaataattactatatgttattcctctatcctcagtagactaagttaaatagaagagattttgattactttatcaagttactttttggaagaggatttaaaaccaaacttacagaaatccaatgggaacaatttcacaaggcttttttttttttcatttcaattattctaccaatttaggctactatgtaaaggtttttatttagcaaaaaaaaaaattgctttttcaaaaatctattttttctctaaactcaggcaacaaaaataagttgcattaaaatcactcatttaataagctgtttttcctataatggctgaacaagagaaagatctgaataaaagatgtaagatgtatagtttggtaattgttacagattctctttttggctggcattttatcagagagaaacactgtttaccaacaccacattgcttagttctttccaaattacttcttgcctggagagaaaacatggatatactaggtgtatttccacctaaattatgtgcacagaaaaacattcttcagtttgttttttaaggaaacttgtttcccattggaattgcttgatcaaaattaagataaattagaaaatatcattatgtgccagggtttttattctgcaaattctaacttcttagcttatctcctttttatttctttcttcctcatatatatttcaatagacaaacagtatgtgaaaaatgctcttttccattgtaagagcaattatgattaaatacatatgtgtgtagtgtgtataaattttgtgtattttcccttcctttatagcagcagttttacttatctgttttttgtaaaagacttaatgacaaattaaggttttaagaattcagtgacacttgaaaaaacatttttatttaattcccgaaagcagtatacacacgcacacacacatacacacacacacacacacacacacattttattctagagacaacacttcattatgttagaaatctatgataccctacagaccatccagccctcttctcagctcccctaacaccagggggtttgcaggaccctagcggagattcatcacatttgtacataaacacacattttggaggagaaggctgaagaactaagcgaaggcatttattccacgagggtcacttctgtaatgtccccacatggtactgggcattcaactgatgaactattgaagaagtgatctctgtatcagtctatagagtagaattatccagcaataatcattaaaactgctgagtcgttgcatactaaaaatgaatattgaatctaggaagctgaaactttaatccattttcatatactcttaaaatttttaataaaattcaaactcggtcagacatatcacataattactttagggattaaaaatatcataatctctcctgacaagtcattttaatggtcagtgaatttgtatgctatctgtgatcttacttagtggatatatctcaatttctgctttattacattccattaccatgttttattcatctgcctattcctctcctgcttaaaatttccaactgagaaaagaaatgctttaactttcatgaaggctgaatcctcctcctatccagtaagcaaggctctgaatctgattacattcttgacagacatattttttatctataatgagctaagacaatgtgcactctaaatttaccttggcttctgtaattgatcaattaggaagcataaagtatagccactatcttcatattttttcctgacctgtttatgagtaatcttaagcttctttcatttcagtagtcaaatttaatgatccctggtaaatcggaagacattttgagatgaataatctaggtgaaaaggagagcacggtgtttctgattaactgtggttgttcctataagcatggcagtcaatacattatgtaagtgccattgaacaaatgcaaacctttataataatattggacacaaagcaattaaatagtaaagactcattacagtgttgagtagaattttcatggtgcctatatttctggataattatagttatgttttccactttggtattcaaacagaaagaatctgttcttactaaaaggatgttaaagtacccctctctttatcccaatatgtggaagaatactgagcagcagaaggaacaaggctgccaatgcagcaggagacattgatggtgccaaaaaatgcactcaccctgtattctcaaattaagagccaccattgccaggtgaagatttatttgttctttgagcaagaagcagacatagcaacagtgacagtatggaggaatgttggtatagcacatactggagaggaaccagcatgagttactgggcttttgctaggttctgggtaccattttgtgtgatgatatcatcagtccattagtcagaggtaacatcccaataaacaggaagtaacaatgcaaggtaatgagtgctatgatgtgggggaatattccacaggatgcaataaaagcagctattcaaccttgggaggtcagacacgtcttcctagaaaaggtgatatgtgacataaattctagaaccatcctactgtactgaccaaaagcattagcattgtctaggagcaactgatataaatacagaatattatgcccagcctaggcctactggaataaatgtgtattttaaccagatctctaggtaattcatacatacatttaagtttgagaagcactgttctggaagataactggtacatagccaagtgaacaggcaggaagacagccttctaggcagagggaacaatactggctaggggatagagggagaaaaaaacttgtcctgtactgagaaatgcaggcatatactggttggtatggcagaagaacagggtttaatgggaaaggtggctggaaatgaggtaggggaaatgtgcagtagttggataatattaagttgataatcagataatgctatattaagcagttggactttctacaaggtaatgattaatagaaccaattttgtattttagtaagattaactgctaaatggagatctgatagcaggaagaacatgcagtagttaaagaaatgaaaatgatgaactaaactagatagtggcaatgaggatggaaagaaatgcacaaattgaagaaatagtaacattaaaaatttgagaagacttggtgagcaattgagtaaagagggttaagagggtttggcagtgaaaagagaaattcaggatacctccagatttctggtttaggcatgaaagtagttggtgtgaccaatccctgagaataaagatggaatttagatagaaaaggtaagccatgtggaacacgttgagtttgaaatatctgtagaatgtccaaatggtaatatctagtaaccgtttactacataagtctagagctataaatacgaaagtcgtccacactgagttgttaacaaagacttaagagtggattatagtcagaggtggagaaagatggccaaatagaagcctgtattgatcatcctcccgcaggaacaccaaattgaacaactatccatacaagaaagcaccttcataagaaccaaaaatcaggtgagtgatcagagtaactgggggagggagaatgaagtgattgtgggactgtgcattggaactcagtactgccctgtcacagtggaatgcaacaccaggcagaactcagcctgcgcccatggaggaagcatttagaccagccctagccagagggaaatcgcccatccagcagtaggaacctgagttcctgttagacccaacactgcaagctaaagtactctgggatcctaaaaaaacttgaaaagcagtctaggccacaaggactttaatttatggaaaagtctagatgctgtgctaggctgggagcccgtggatatggggcacacacggcccagtgagacactagctagggcagccaagggactgcttgtgtcacccctcctccaactccaggcagtgcagctcaaagctccaggaaagtaaagaggacttggtcttgcaacttggacatagtaaaataaatcatggagcagagtcctgatgctctcatttcaggccctagcacccagatatctcaagactcaacctggaacagaagggaactcgctacgttgaagggaaagaagcagttctggcaggatttatcacctgctgactaaagaacccttaggtctagaataaatatcagcaggagacaggcagtagttgccatgggcattgggtgatacctagtaccatgatggcttttggtgtgatccagcacattcccagttgtggtggctatagggagagactcctgcttgagggaaggagagagaagagtgaaaagcactttgtcttgcaatgtggatacctgctcaggcactgtaaaataaagcatcagagactcccaatttctctaattccaggccctagttcccaaatggcatttctaaaccagccctggggcaagaaggcaacctgctgccatgaagggaaagacacacatttggcaggattcaccatctgctgactaaagagcccttggtccttgaataaacctcagtggtaccaggcaatagttgctacaggccttcggcaagacctggcactgagtactgtgccagcttcaggtgtgacccagcactgtcccagtggtggttatgggagtgcttgcataatcttttccccagttctgggcagctcagcacagacagtgactccatttgtttgggagacagtaagggaagagaataagagattgctggtaatccatagaattctcctggatctcatccaggaccatcaaggtggtacctctacaagtctgcaagagtcacagggttactaggcttgagatgccccctaatgcacatgtggctgcaatgaccaaagatgtagatcacaacacttaatgttctttgaataattggaaaaccttcctaagaaggatagatacaaacaagcccagattgcaaagtttagaataactacgtaagtcttcaatgcccagaaatcgatgaacatccaccatcattaaggctatctagacaaacatgacctcatcaactgaaataaataaggcaccagtgaccaaacctggagtgacagagataatcaaactttcagacagaaaattcaaaatagctattttggggaagctcaatgaaattcaagataacatgaagaaggaattcagaatcttatcacataaagttaataaacagaatgaaataattcttaaatatcaagcggaaattctgaagctacaaaattcaatggaatgcatcagagttttttagcagcagaattgatcaagcagaagaaaaaattagtgaacttgaagacaggctttatgaagatacacagtcaggggagacaaaagaaaatagaataaaaataatgaaatatacttaaaagatctagaaaatagcctcaaagtggccaatctaagggttgatggccttaaagagaaagtaaaggagataggagtagaaagtttattcaaagggataatagcagagaactttccaaacctagagaatgatatcaataaccaagtatatgaaggttatagaacaccaaacagattgaaaccaaagaaaactatctcaagacatttaataatcaaaattccaaaggtcaatgataaagaaaggatcctgaaagcagcaagtgaaaagaaacaacacacagtggagctccaaaacatctggcagcagacttttcagtggaaactttacaggccagaagagagtagcatgacatatttcaagtgctaaaggaaaaaaaaaaaaacttttattctagaatattatattcagcaagaatatccttcaaacatgaaggagaaataaagactttcccaggcaaacaaaaagtgagggattttatcaataccagacctctcctgcaataaatgttaaaagtagttcttcaaccagaaaaaaatgatattaatgagcaacaagaaatcatctgaaggtacaaaactcactggtaatagtaagtacacaggcaactacagaatattataacactgtaattgtagtgtataaactacttatatcttgagtaggaaaactaaaaaataaacctctcaaaaataatacctatgaccacttttaaagatttagacagcataataaaatatgaatcgaaacaacaaaaagtgaaaaagcgggggataaagttaaaatgtagagtttttattagttttctctttacttgtttgttagattgttcgcttttgcaatcaaagttaaattgtcatctgttgaaaaataataggttgtaagatgttacttgcaagctgcttggtaatctcaaatcaaaacacctacaaaaaaaaagagcaagaaataaaaacataccaccaacaaaaagaaaatcactcacaaaatgtaaaagaggaagaaagaaaggaaaaaagataaatccacaaaataaccagaaaaatccaaggtgacagtattccagaatagaccatatgttaatccacaaaacaagtcttaaaaaactgaacaaattgaaatcatttcagacatcttcactaagcacaatggaataaaactagaaattaataataagatgtactttggaaattatactaacacatggaaattaaacaatatgctcctcaatgaccagtaataaataaataaataaattttatttatttaaaaataaaatttaaaaattttttgaaacaaaagaaaatggaaacacaacataccaaaacacaggggatacagcagaagtggtactaagaggaaagtttatagcaataagcacttacatcaaaaaagcagaaaaaccacatttttatttttatttatttatttttgagacagaatctctgttgcccaggctggagtgcagtggcaccatctcagctcactgcaacctctgcctcccaggttcaagcaattctcctgcctcagcctcctaagtagctgggattacaggtgcctgccaccacacctggctaatttttttgtatttttagtaaagatgaggtttcaccatgtaggcccagctggtctcaaacttcagacctcaggtgatctgcctgccttggactcacaaaacgctgggactcacaaaatgctgggtggctgtgagccaccgcacctggccaaaacttcaaataaacaacctaaaaatgctttctaaaaaactagaaaaccaagagcaaaccaaacataaaattagtagaagaagataaagatcacagtagaaataaaccaaacttaaaaaaaaatcaatgaaacaaaaagctggtgtttcaaaagataaaatctacaaacttttagccttactcccccactgccaaaaaaaaagagacaagacccaaataaataaagtcagaaatggaaaagaagacattacaactgccactgcagaaattcaaaggattactagagaccattaatatcaactatatgccagcaaattggaaaacctagaaaggaatgaattaaacatagtaatgcttaaaattgaaccatgaagaaatccaaaacctgaatagattgaagccataataaaaaaatctcccatcaaaggggacttaatggcttcactgctggattctaccaaacatttaaagaagagctaatactaatcctactcaaatcattctgaaaaatagaggaggaaggaatacttctaaactcattctatgaggcctgtattacccagacaccaaaaccaaagacacatcaaaaaaataaataaatataaagaaagaaaaagaaagaaagaaaactataagccaatatctctggtgaactgatacaaaaatcttcaaaaaatattagcaaaatgaattaaaacaccttaaaaagatcattcataatgaccaagtgggatttttcccaagaatgcaaggatggtttaacatacacaaatcaaacaatgtgatgcatcatatcaacagattgaaggacaaaaaccatatgattagttcaattaatgctaaaaaggtattttataaaatttaacatcccttcatgataaaacccctcaaataactggggatagaaggaacatacctcaacatataataataaaagccatacgtgacacactcacaactagtatcacactaaatgggaaaaaaaactgaaagtattttctctaagatctgggagaagataaggatgcccacttttatcactgttattcaacacagtactagcagtcctagctagagaagctagccaaaacaaagaaatacacagcatccaaatgggaaggaagaagtcaaattatccttgtttgcaaatgatatgttatttttggaaaaccctaaagactccaccaaaaagctattagaacttataaacaaattcagtaaagttgcaggatgcaaaatcaacaaacaaaaatcagttgcatttctatatgccaacagtgaaatacctgaaaaagaaatcaagaaagtaatcacatttatgatagctacaaagaaaataaaatcctggatggaattcccagagataaccaacaggctctctgacattgcaactgcagaggtacttgccattgctgcctttggtcagtgaaccagagaaagaccctgattggttatttgcacctctagtaggccaaaggtactctctatggagagaaggccagtttctcttccctgtgaacccttcaacccctgctcttctctaggcagggcccctggtttgggcccacagcacagtcactctaccagtggctgaacatttccactgacagaggctttgtgtctctctggggtggagttcctggaggcaactgacagcccctctgccactgctgttgtagtgctacccatcttggctgccaccaggcttgggaagaaacaaaaagcccaaatgttttatttgcacctccaggacaccgcagccacactatagaaaggaggccagactgttttcactgtgaatcccccaggtccccgctcttcaacaggcagggtcctagcttaggcctgtagtgtagccactccacacctggctgatgattttgattggcagtggttctgtatttccatggggtgtaacttcaagagggaagtggcaggcctctgccattgccactgccaagggccctgtccctgctgccacaaagtgaggagggaacaaaaagcctgagctatccccaaggtggcagcatatagcccagggtgccaagctaaggtctatggccaaaactcaagtgagagggaagctcacactctcagagcactgagagagtgcatggctgcaaatgcgaggaaatatagagaagctgcaaatccttaaagaaaacaaattctaagcaagaattccatatctagccaaactaagcttcacatgtgatggagaaataaaatccttttcagattttactcccctttgcaaatgctaaggaaaatcattaccaccagacctctattacaagaagtacttaagggagtgctaaatatgataacaaaaaactgctattggccactacaaaatatacttaggtacatagaccattgacactataaagcaactacatgatcgagtctacctaacaatcagctaacaacatgatgacaagattgaacctgcatatatcagtattacccataaatttaaacaggttaaatgtcccatgtcaaaggcacagaatggcaagttggataaaggcgaggacccaaatgtacgctgtcttcaagagatccatctcacatgcaatgagagataccataaactcaaggtaaaagaatggagaaagatctatcaagcaaaaagaaaaaaaaaaaagaagaggggttgctattcttatttcagacaaaacagacattaaaccaacaacaatcaaaaaggacaaagaagtacactatataatgataaatggttcaattcaacaagaagacataactatcctaaatatacaggcacataacactggagtatcttaattagtaaaacaagttcttagagacttacgaagagacttaaataaccacaaaataatagtgtgagaatttcaacaacccactgatgatattagattattgacatagaatactatcaaagatacttggggcctaaacttgaaacttgaccaaatggacctaacagacaactgtagaacatgccacccaaagagaatagaacatacattcttctcatctccacatggcacatagtctaaaataaccacacactcggccataaagcaattcttaataaattaaaaaaaaatccaaaattataccaaacatactctcagatcaaagtgtaataaaatcaatatgaagtacaataaatcaatatgaagaatatctcttaaaaccataaaattacatggaaattaaacaattggctgctgaatgacatttgggtaaacaataaaataaagacagaaatcaagtaattatttgaaactaatgaaaacaataaaaatcataccagaatctctgggacacagctaaggtagtgttaagatgaaagtttagagcagtaatgcccacatcaaaaagtgagaatgttctcaaattaacaacctaacatcacatctagaggaactagaacaacaagagcaaaccaaccccaaagctagcagaagaaaagagataaccaaaatcagtgctcaactgaattaagtagagatgagagaaaccatacaaaagactaataaattcaaaagtttgttgcttaaaataataaataagattgataaagtgctagctagactaataaggaaaaaaaatgagataagatccaaataaacacaatcagaaatgacaacgatgccattacaattgattccgcagaaatactaagaaccctcatatactattatgaacacttctatacacacaaactagaaaacctagaaggaatggataaatacattcaatctcccaagattaaacctggaagaaattgaaaccctgaacagatcaataatgagttttgaaattgaatcagtaataaaatacctacaaaacaaaaagcccaagatcagatggattaacagctgatttcttccagacttataaagaaaagccactgccaatcccactgatattattccaaaaaatcaagaaggagggactcctatctaattctatgaggacagtatcattctgatatcaaaacctggcagagacacaacaaaaaaagaaaacttcaggtcaatatccctgacgaacatagatgtgaaaatcctcaacaaaatactagcaaattgactctagcagcacatttaaaagcgaatccttcacaatcaagtaggtcttattcctgggatacaaggttggttcaacatacacatatcaataaatgtgtttcatcacatacacagaactaaaagtgaaaaccacatgatcacctcaatagatgcagaaaagggtttgataaaattcagcatcccttcttgttaaaacccacaacaaattaggcatcaaagcgacatacctcaaataataagaacgataaatgacaaacccatatccaatatcatactgaatgggcaaaagctggaagcattacccttgagaactggaatgagacaaggatgcccactctcacctattgaattcaacatattattggaagtcctagccagagcaatcaggcaagagaaagaaaaaaagcatccaaataagaagacaggaagttaaactatctctcctcgcagatgatatgattttatatctagaatactcccagagtctctgcttactagctcctagatgtgataaacaactttagcaatgtttcaggacacaaaatcaatgtacaaatatcagtagcatttctacacaccagtaatgtccaagctgaaagtcagatcaagaatataattccactcacaatagcattaataataataataataataataataataatagtaaaatatctaggaataagggaggtgaaagatcactacactgaaaattacaaaacactattgaaggaagtcagacattgtcacaaaccaatgaaaaaacattccatgctcaagaataggaagaataaatattgttaaaatgaccgtactctacaaagtaactgaaagattcaatgctattcctatgaaacttccatgacattcttcacagaattagaacactatgcagccataaaacaaaacaaaacaaaacaaaacaaaacaaaacaaaacaaaacataacagaatcatgtcccttgcagcaatatggttggggctggaggccattatgctatgcaaactaacacaggaacatactgtgtaacaaaccaaatactgtatgttcccacttgtaagtgcaagctaaacattgagtacacatggacacaaaaaaggcaacaatagataccagggcctacttgagagcagaggttggaaggaaggcaaggatttaaaaaagtacttaacaggtactatgctcattacctggatgatgaaataatctgtacaccaacccctgtgacacacaatttatctatggaacaaacctaaacaggtaacacctgaacctaaaataaaagttaaaaggaaaatgtttccagttaattacttgaatccacaaagtgaagcacacatgggaaataaaacgtttaacattataaaattttaaatatataattgttctcctgtcttttttaagcttatttaaagcaaagaaacttatataaaaaaagaattatactacagaaccacagtaaccacaacatcatggtactggcaaaaaacagacatatagaccaatagaatagaatagagaactaagaaataaatccatacatctacagtaaactcatttttgacaaggcaccaagaacctacattggagaaaagagtgtttttaataaatgatgcttggaaaactggatatccatatgcagaagaataagactagaccaccatctcttgccatctacaaaaataaaatccaaagatacaagatttaaatctaagatctgaaactatgaaactactaaaagcaaatattgggaaagcattgatctgggcaaagatttcttgagtgataccccacaagtacatgtaaccaaagcaaaagtggacaaattggatcccattgagttaaaaagcttctgtacagcaaaggaagcaatcaacgaagtgaagagacaacccacagaatggggaaaaaaatagcaaactatccatctgacaagggattaataaccagaatacataaggagttcaaacaactcagtaggaaaaaaacctaataatctgatcagaaaatgggcagaaatctgaatgacatttctcaaaagaagacatacaaatggcaaacaggtatataaaaaggttctcaatatcattaattgatcattacagaaatgcaaataaaaactacagttagatatcatgtcattccagttaaaatggcttttatctaaaagaccagcagtagcaaatgctggcaaggttgtggagaaaagggaaccctcatacactattggtgggaatgtaaattagtacagccactttggagaacagtatggagattcttcaaaaaactaaaatagaactaccatatgatccagcaatcctactgcttttgtatacataccaaaaataaagaatctcagtatatcaaaaagatattcctactcccaggtttattgcagtattattcacaagagccaagatttggaatcaacctaagtgtccatcagcagataaatggataaagaaaatgtggtatatatccacaatggagtaccattcagccataaaaaatggataccctgtcatttgcattagcatggataaaactggaggacatcacgtcaaatgaaagaagctaggcacagaaagacaaacttcacatattttcactcatttgtgggagctaaaaactaaaacaattggactcctggagacagagaatagaatgagggttaccagaggctggaaagggtagtaggggttgcaggagtaaagtgaggatggttaatgggtacaaacatatggttagaaagaagaaataagatctagtatttgatagcacaacagggtgactacagtcaacaataatttattgtacatttaaaaataactaaaagattatcattggaatgttcataataccaagaaaggataaatgcttgaggtgaaggataccccatttactcttaggtgattattaaacattgtatgcctgtatcaaaatacctcacatatatctcatatacacacctactatgtacccacaaaaatgaaaaaaatattagatgggaaacagagtggattacatcacccagggagagcattcaatttgaatggaaaaataagatggaatattgggtaacaccctcctttgatgggcagaggaaaaacagcactaaaaacataccagaaaggattagccagagggttaggagaaaaatgatatattattaaagaagaagtaatgttttaataatgtaaaatctttattgctgatgtgaccttgctaaaagcagtttcacagaaatgatgggataaaaaagtgagtaggaggtgggaggaaggttaaaaataagtgaggataataatcagttgactgctaatgaacgagagagggaatatcttaaggatttttgttttgttttgttttgttttgtttgtggggggaaacagggtctcgctctgtcacccaggctagaatgcagtgatgggatctcagctcactgcaacctccgcctcccaggctcaagcaattctcctgcctcagcctcccgagtagctgggattacaggtatgcaccaccacatctggctaattttgtatttttagtaaagatgggagtctcactatgttgcccagctggtcttaaactcctggtttccagtgatctgcctgcctcagcctcccaaagtgctgggattacaggcgtgagccaccgcacatggccacttcaggaatttttaaatacagaaatctaaacttggtgggcctgcccaagttgttttgtttcattttaaagtattttcccaaaataaaaaaaaataaaaacagccactttctttataaaatcctgcttaatgaggtttatttctgtttaagtttgtagcatgttatgcaaacatcaaaactgcgaaattgtggaagtgatcatcattaacctgatgaccattttgctatagggccaagaacagatggagccggtgggatctcctgacattctttccaaacttggaaaatccagcctgcaatatgacaaaatggtattttcactccctgggacttagtaagcctttgttttgaataacaaatatgtttaacatattaaagtcaccatctatctatgatataattaactatagaaaaaaaacctacacgtgctaacattattgtcaggcaattaaacaaaattccaggtagattaatgtttaatttaatgagctaacatttgaattaagatcttgtgacattaatgatatcgagagctgtcaagagtgaagagccctgtcatgagtcgctgctacacaaacatcacactgagcctttataatggagaaatggatgactcgagaccagaaggtctctaagcatgactggaaaccatggtcaaaacctgacatttgaaatattgctggttgtgggaagaaagaactttccacagaccaggcagatggtcatcatatactacgcacaattcttctttccctccaccctacatccctgtccctgtcccagatgggagaccactaccaccaattaaggcaagttgcctgcaaaagttctttatgtttcattggtaatgactcgatagagcaggtgtaacttcctcacttcataaaggctgaaactgagcaaagtgaagtcaggcaacttatgcaagtcacacagctagcggactcaaagcacagtgtggcagatgccaacattcgtgcctacaacagtaaagtaccacctcctaggaactcattagtacttacatttcaggcttgtgtttggggttgtgtttggagtttaatgtttcacattgacatctctcgtttcttcatctttcttattcctagagcttatctttctgagcattgtttatatcaagtaaccttttcttacaattacctcacataaaatttttactctataatttgagaactttataaccatgatccattttactcattttatctcattctttttaaaaaatctgattctttataacattttgcttgtgtacttccctatcatactgtgcaaggctgctaattttctccagttttgttctatttatttcactctgttctattctcttccaaaattattatttttccaaattatctttccagtacaggttctatttcctccaattttttaatatttagttgtagtttttataaatgtaaggtacagtttctattatgtttctgtccagttttacaggtgttatttaatgtgcataatactgtatactgttttgtgcttcccattttacaaagcctaggtattatctcaactaattatcctttttcatatacacaatcaccctaattgaattacaaattctatcatgttctttgtgaattaaataaatctgggatctgctagcactggctgttttgtaaatgaatgtcaaccaggcagttcacacgtatgttcaatcacattctcccctacaggagagaatttcagataggcatgaagcctaggacagctgaagagtgcttctggaaaacagacctagacttcacccagtacaaagtaaattcaccccaatgatcaggtagtatatatcaagagcatcctgaacaaagtcagggattgtatgtaaaatgggatgaaacaagtccttataaaaatggctccatgtcacatctcagcgtgtaaggtaccatctatgctccagtgagaacttttaaagctaaacctctgactatagcatactgtgttatctattgctttatataacattgccttctgtttccatatccttctctgttaatgacatttcacattatctgtgtctttacacatttttagtagctacatcactgtccactgcaaacccacaggatcctagacctgctctttctctaatcttctgtatcttagcaatcggccaaaaaacttgaaatcatacttgatttctcctggccctcaaagcctacattcattctgccaaatcatgtaagtccatctttaaaatttatactgactgtgcatttcttcttatctccattactatcacccaagttcaaaatcctttcttatttttcacctgagtattgcaatattttcttagatgaccctaactgatcttgccgtttctactcttgctttcctacagtcaattctcttcatatatgccaacattaccttttaaaactacaaacaagttcaggttacttcttccttgctcaaagtctcaaatatctttttatcacacacaaatcaaaggtggctaagaatggtctgggtcctgcatacctctccaatgtcatctacagcatctctgactttctcgcactgctctggtcacagtggtcttctttttctctaatacactaagcttattccttctttagggtcttgacttttgcctttctccccaaaacttatattgtgtggcttgctttctcactttattcaatattcaacaagtctttagagaggtggcccctctgactactctatctaaaacagcaatcccatttacatactctctctctatcgattttgccttattttgcatttactttatggcacttttcactacttgatattatcattaatttcactggtttgttgactggcaccttctccactagattataaattccacaaaggcaggaatttggtctgtttctgtcttctctaattccagtgactagaatgattcttgttacatggaatgtgctcaataaatgtttgttgaataaactattactatttacatccacctttacaggaacattttgaaggaggacagcataacagggaggtgtcctaatagcatgatagatggtgaaaagaagacgtgatacagagttagacagagttcaacttagactggctgaaacagtaagtttgcccttaactatttaaccatttgatttttgaaaagttgcttacctctctaaatctgtttttggtttgtttgtttgatttataaataggaatgataatacctatttttcaaagcttttgtaatgacaaaaataattcatatggaaatattggcattatgcatgtcactgcaactgatcaattccttcagggctatcatcattcaggacacagtcctagggtgaggaaattaacctcagtttgagttcaaatgacaaatatcaatttaataaaacaaactcttttcatttcaggaaatgttgatgttcacattagaaaaagggtccagtagcatttggaaaaatgcctgcttaatattactctatctaagctttgttaaactttgtattttagtaaattactcagtaaagtttgagcatagtggagcactttctcattgaattaaaaacattccatttttaactgtaaacacacgttctcaatttactattctccataggttaagacatttattaattataatctatactaaactattgaaagagatgataaaggaatcaaagaaattccaaatccctccagaaatgatttagtctttttttcctgactcaagaagccaaacttattactctacaaatagctttcactttagaagactctaactgaatatataaaatctattaggtatattatcatttatatgaaaattttattgtgttcagataaaatgtgcacttccaatcttactagaatttcctcctaattaaataaacatatcgctggcagattcaaataatttaaaatgttttgtttcagacatataatttttaaataataaaaactttctaagctttcaaacaaggattttacacctattacacttattttatttctaggaacagaggctaaaagaatgcatctcccatttttaaataatcatatacatatgtgtgtatatatatatgatataacgtatcctgtacatatatatgtatgtataggacacattaaggcaactcaaaaattaattttaaattcttcaatctaaaaacaataagaaacattgttccttacaaaagtgctattttattaggctaacttggtctatgtaataaatgtcatttgtagtttagagcaagagtgatttatagctagaaagatttagaatttagtttttgtaaataattatcttattatgaagactgaaactatttgatatttatcaaaaggcttcaggaatattctgctgccaaacacacagattcctcctttgtgagtgatgtttgttaatatattaaatgaagtcatttcggagaatatgagatatgcacatcattcatgtattcattcattctattgtttatttgctacatatttattgagtgacagctatgtgttcaccatggctctaaagaatgggatatagcaatgaagaaagaagatggtggtatgcataagtagatgttcctattcaagtctaaagaacatgtcgagctcacattgaatggtgtatgatatacaaatatacctctcagaacacaaaacattttgcatatcaaacctgtcttccaggggataacccttaagctaaagctaaattaacaaagtaccaaaatatggagtcatttaaattaatttggttgaaaagttggtcatccaattatattatatcatatagattgaattgtagataaattgaaagctagtttttttgttttatttttaatgggacatggtgcaccttagatttggtcatcagctacttatatcatgtttgactttccaagcttcaaatctggtaccctaacaattggaccagttctataaacttactcctatgtaggatgatattaatgttttattcagtttaaataaatcttgactctcctatgcttaacaggatttttcaatacattatattttggagctggcattgtataaatatgaaaatagtcacataccgctgattctggctgtttggttagcttgagaaatgaactgatagtcacagaaatttatatcattgtcattaacttcaaacacttgtaagctactcaacttctggtagcatggaagtgttgtatcagttgtataggactgttaagccacttttaaaaagtctttgatctgctgggcgcggtggctcaggcctgtaatcccagcattttgggaggccaaggcaggcggattacaaactcaggagtttgagaccagccaggccaatgtggtgaaaccccgtgtctactaaaaatacaaaaattagccaggcatgatgacacgcgcctgtagatccagctacttgggaggctgaggcagaagaatcgcttgaacccaagaggcagaggttgcagtcagccgagatcatgccactgcactccagcctggagacagagcgagactccgtctcaaacaaacaaacaaacaaacaaacaaaaagtctttgatcatatttgtaactaaaaattaaagactctaatgtgatataaaatgaaatgaaacatgaaaataccactttaacaaataacccagtataaaaagaaaataaaagaaaaactagctaactgactaagaaaattaattctttgtatcttaaagggtagttggcagtgggtcctggctaactgaagagcagatacagaactctggaatactgaaccatagcatgaattgatacgaactgcattttggctataatcatattagcacatagaaacaaaagaaggttggacagagtgcacagtgatctctctactatagatcaattttgtaggcttgcttctcctgttgatgataaaataaactgctcttattctatgatgaataaacccacaaatactccaggacacttagatgggttgaggagtaatttaagtatgtggtccacttgggacataacagggtatagctagtgactgctctgtaaacatagctgtctgggaagtggaaaacactgtgatgcaatgtgggctctgaaggacagtatctaagttaagaaaagagcagctatatcacaataacacaatggtaccttagaactgattaaatgataaaagtcatctagttcaaaggaagaatgagaaaggttattgcacagtaggtggcagagttagaaatgaaatgctgctctggttctcaggcaaatattttaggcccagactcataatttcattctgcaatttatttgtaagtttatttgctagacattgctttatcatttttcaaagattgcaaataaaagcttagtatcaattaaataaaaatatttgattcctaaaacagaaattaaaagaaagatagttttgtacaaaagtgcatatttcctcaacaaaactctcagtattatattaagaaaatcacttagcagggatgaaagataaaaatgtatactatcaatttacattaagagatataacaagagtgtgttatatatataagagtgtgtttaaataactctgtccgttatttaaacagagtgagaaaaataatggttttcatcagctctaaaactcatggaacttctctctgaaaataaaccatgctgagaagcctttaagaagttaaatagcagaaactctcttgagaagtaaatgttaaaattatggcaatatcccttagagttttcacttagaattaaagcttttcttttctttattttaaaaacttttatttcaggttcaggggtgcatgtgaaggtttgttacacaggtcaacttactggcatgggggtctgtagtacagatcctctcatcaccccggtctccagcctagtacctaacagctatcttttctgctcctctccctcctcccaccacccaccctcaagtagacccaagtgtctgctgtttccttctttgtgttcatgagttctcatcatttagcttccatttataaatgagaacatgtggtacttggttttctagggaactacatttcttctatacctttgtcatgttgtaaatctgttttattatattgtgtgttacagttcttagagcaaatttcctctgaatgccgtgtgatgtggtttcttgccaaaagggaatgtttaaagtaaagttgagtaaatctagtttatcgtcatgcatatcaaaacactgcctagctctgataacactcatctcacttctttcttttcttcctctaaagcgtcattttgatcccagtgttgcaaaaattaatgttctaaattcatattccctattgtgttttgtatatgctgtaattcatctagttttcaacacaatacaggttgtgcatccctaatctgataatcccaaatccaaaatgctccaaaataacaactttttgagtgctgatatgatgtggaaaattccacacctgatctcacatgatgggtcacagttaaaatgcagtcaaaactttgtgtaatgcacaaaactattaaaaaatattgtataaatcatcttcatgctatgttcataactgtatataaaacaaatgcatccctggttactcctgggcctcattctcaagggatttcaatacatatatatgtaaacattccaaaatccagaaaaatataaaaatatgaaacactcctggttccaagtgttttggataagggatacttactctgcctggcttaattgagtgtaaagtctttgtataaagagacacaagagatcacagatggcaggccctgtgggatgacatctgaagtgcactgattgctagggctggaagcctgagactagacacttaaatttttcctgtgctacttggtagctctgtaaccttagagctagtcctttttgccatcatgagtctcagtttcctcgtgtacaaagtggcaagaataagtgaggaagatatctgtcctacaagttttataacgtttttaatgaagatcaatgcagaaagtgcttaataaatctttctgttgatgttctcactctcatatttccccccacattcaacctagttctattgtcaagatttacacatctttttgtaaaatctaaattgctgtagaaacatagggtagtgttattctatccggcaatgtgccaggctgctatgcagggctttgctactggcgagcttttccttttattcagtttggtacacagagaggttccacaatgtcaatgattattatttttattcattttaaagacagtttcacttgtgaaacatgtaaccaacactctgtgacttcactaggatcacaataacctgaactttgtttatgaatttaaaagtatctttcatgagcaaatataattattctggtgaaactatgtgaggaccaaagtcactgaaaagtttatgacttactgtaactgtaagaatagaaacacaaatttggcacaccagtgcacattatcagtttttaaaagctacattttaaaaataaatgtataataactgtgggatctgcactgattggacaggaaatgtataatgaaacatgactttggaaaaattacagcatgcgcacccattgggcaatatgacatgaattacaaatattacaaagtgaattcattctgttgttttctttttcaatgattacttattctgtcatctgttaatactgatcataaattgtgtcacttccaggaaagtttctctaattacaaagtgaattcattctgttgttttcttttcaatgattacttattctgtcttctgttaatattgatcataaattgtgtcacttccaggaaaggttccctaataaatccagaggaacaaataacactctcccaatgaaagcttgttttactccacagtgagtcatcatggacatgacctttctttcgccatcgtatgaaaagatgtgcagatattggctctgcacttccacatccagctaaatccctcctcagctctgaagtctggctacacaaatctgtaaccatcttcttgttccgggaactcttgtggcatggttgtctaaagtacatagttgatcaaaagcatatattaacttaccttgctttgcatctttctaaatataaattctgactacatctaggtgtgattctcttacatctgatacttctctgcaacttttgtctcagcatagtaaccacctaattgggccaacatacaaatccttgaggaaattaatgaagaactgacggttaagaaaccttcctgataatttaactcttgcttccctgaacagattcactcctttcacgacagggaaggtgttttgattcctctaatttcttcagtttaacacactgatagaccagagggacaggaagaaattgtttaataaatctctccatagctgtcctcgctctcacatttgccctcacactcaaccttattctactatcaagagtcaaaaagtgccatcggcacctggctcctctacctccttgtgatggtccctgtcttcagttggagcaatcaattaggaaagctcatatatttcccttttcaagtaactgataagatcttatgaggcctgcctttctctactcctgttagcaagtaattaactttggaattacgaaacaccaaatccccaaagggcaacaataacaaccacagaatgcagccaaaaaacatatgaaaaaatgctcatcatcactggccatcagagaaatgcaaatcaaaaccacaataagataccatctcacaccagttagaatggcgatcattaaaaagtcaggaaacaacaggtgctggagaggatgtggagaaataggaacacttttacactgttggtgggactgtaaactagttcaaccactgtggaagtcggtgtggcaattccttagggatctagaactagaaataccatttgacccagccatcccattactgggtatatgcccaaaggattataaatcatgctgctataaagacacatgcacacatatgtttattgcggcactattcagaacagcaaagacttggaaccaacccaaatgtccaacaatgatagactggattaagaaaatgtggcacatatacaccatggaatactatgcagccataaaaaatgatgaattcatatcctttgtagggacatggatgaagctggaaaccatcattctcagcaaactatcacaaggacaaaaaaccaaacaccacatgttctcactcataggtgggaattgaacaatgagaacacatggacacaggaaggggaacatcacactcaggactgttgtggggtggggggagtggggagggatagcattaggagatatatctaatgctaaatgacaagttaatgggtgcagcacaccaacatggcacatgtatacatatgtaacaaacctgcacgttctgcacatgtaccctaaaacttaaagtataataaaaataaaaaaataaaataaaaataacaaccacagaaacccaaaccaaacaaagaaaacaaaaagccccaaagatcaacctttcagcctgaggctgctcataatacacattgcaaagatcttcattcctctcttaaaaatgtaaaagagggaaatgacacaggttatttaacatattgtccttgggctttgatataatttgcttgtgaagagttgataggcaagacctgttttctaattaggtaaatttgaaaaagcccaaaatgagctaatctcgctggttctagctgaatctttggtttagctcctgagttgctggaacttgcattctaatttagttctatcttcccagtaaaactgtcctgagaggtcctggactgtcgccccacagtgcaatggtcctaggaaagtgatagggcaccaaacagcttcaacacctaccaaatcagttagcggaacgttgcaattaatggtcctttcctaaagattaataatgaatatcagtgcattaagacgtagattatcttttgtacaaaaaaaaaaaaaaacgcaacaaacaaaacactttccttttctaatcttatgcaaatcctccagcattctaaaggcatgctttataaagtactgggatacatatcgaaaacatttcttagatgctttaaataaattctcccttcatctgagtcttagaattcatctactaattactttaataatttaggaggcttggatgaattgggaagggctcaaatttatattcacccaaaggaaatatggattaagaagattgctttcttatgggccttttctccagagatagttgtctgaattaaggatgaaaatgtcaggtcaaactcatttcttattacaatctagcaatctaaatggcagctgttgagatgagtccagagagggttacattcagatttctaatcaagggaacacctttattgactacttaataatcaattcttcttcgcatctctttaactttcaggggaataatttttactagattaaagtggtcacctctttttaaagtaactttgaccctaggtatagccacccctcccgccgacacacacacacatacacactttggtattgagatctattttagtgatttatctatctacatagcaagctgttcctcccaaaaagaacagtatacataatggaaaagttataaatatatacatcaatcattttcctcttcagagcatagttagcatagttatgctttttaattctcctttacatttccttacctaactgaaaaggctacaaaagtaacttactaaagaatctcacatacacatacatataccaacagttcctactcttaggtagaataaagaaaaaaagttatatgcatctttcaaaagaagtaaaagtaagtcagagagagagtttctacttttagttagattcaagaaaaaattacacatacttttaaaaagaattcaaagtcagtcagagaaagaaaatgtccaatcgaaaagaaatacattaaaactaaagacagttgtaatgtctccttttttatttctgatgttgtttatttggatcttctttcttcttttcttggttagtctggttagtgatttaccaattctgttatcttttcaaaaaaattcttcattttgtgatccttttttttcaatttccattttgtttagttctgcttttatcttcatcatgtctttctttctgctaatttggggcttgttatttcttgattttctagttatttgtggtacaacattagattgtttatttaaaacctttctactttttaaggtaaacatttactgatatatacttccttcttagtattgcttttgccgtatctcacacgtttccattttcactatttcaagaaatgttttgatttccatcttaatttcttcattgacctaatgattgttcaggagcatactgtttagtttccatgtatatatagtttccaaagttcctcttggtattgatttctagtttcattccactgtagtttgagaagatacttgatataatttcaacttttaaaaatttgttgagacttgttttgtgggctaacatatggtctatcaagaatgttctatgcgctgatgagaacgttgtatatttggcagttgttggctaaaatgttctgtaaaggtttgttaggtccatttggcctaagtcagctaaacagaaatacaaaagatcaccagagactactagtaacaactacatgctaacaaactcgaaggcctaaagaaaatggatacattcctaaaaacatacaacctaccaagattgaatttagaagaaatagaaaacctgcacagaccaataatgaatagtgagattgaaccagtaataaaaagtctcccaacaacaaaaagcccaggattagatgaaatcattgcctaattctaccaaatgtataaagaagaactaataccaatcctccccaagttattccaaataattgaagacgaggaaattcttcctaactaattctatgaggcattctatgaggccagtattatcctgataccaaaaccaaacaagggcacaataaaaaaagaaaactataggcccaaattcatgatgaatatagatgcaaaaatcctcaagaaaatactaccaaaacatattcaataacacaacaaaaatacaatacaccataaccaattgagatttataccagggatgcaaagatttataatgaggatgtgtgaatcaatcaacatgatacatcacataaacagaaagatggacaaaaaccatatgataatctcaatagatgcagagaaagtatttgataaaatttcatatcctttcataataaaaactctcaagaaactaggcattaaaagaccataccttgaaatagtaaaggtcatatatgattaagccacagctacacaaatttaatatttaggaaaactaaaagactctaccaaaaaattattagaactgataaacaatttcagtatacataatggaatactaatggaatactatttgatcataatacaaatgaaatcatgtcatttgcagcaacatggatagaactggaggtcatgatgtcaagtgaaataagccaggcacagacagacagacagacaaattgccacatgttctcactcatatatggcatctaaaatactttatctcatcaacatactatagtaatagaataatagatactagaggttgggaaggtgtgaggctaggagaaagaaatgaagagaggttgggaaatgagtacatacagttatatagaagaaataaatactaaagttcaatagcagtgactatagttagcaacaatgtactatatatttcaaaatagctagaagagagaacttgaattgttaccaacacatagaaatgataaacactcaaagtaatggacaactcaaaactatgacttcattattattcattctatgcttgtaacaaatacaagtacaccataaatatgtaaaatactatgtatcaataaatgaaaacaactaaagacaaaaataataacttatttaaaaatgagtctaaagaagtgtctgacacaagttctggggagctaacgtacaacacgagtgatgatgatggatgtgttactaaactggattatcataatgattacaaaatacatgtatatatggaattatcgtgtggtatatcttgaatagatacaatttttacttctcaattaaatattttaaaatataaacaaaaagcaaacaaaaaagagatgactgacaaatgcattctttgcatttgaagatctacttaattgtaagaattacttatgatgtatacatcataaacaatgtacagagtagtacacaaattacctttgacacatctttaaattaatttaactttatatatttcgaggaacaaatagatattggacagcacaaatttagtcgaaaccctataatgtattatagcaacttgtcttttgcaagagtatagctactgagtaatattttagcatatatgtttctactaatttaacaatttcaaaactgaacaaaagtttaagtataggctatttgcttgtgtattgtccctcccaccctgtaagagcatgcttagtgtaaatgaaaaaaatgcatttggctactcagattgcattgaaatttgaagctgaagagatttgttcttttcaagaaacaactgggtatcaaggttcccattagtcttattagacttttcctctgcactgtatactgtggacccatttactaactgacatggggtaaaatgacaaattatctcattattaatgaaaaaacccataaaattatttccatatttaaatcacttgcaagattacagttcaaatgacacaatagcactgcacaatttaaactcaaacctttctgtaaagctgaaaagcagattaaatttgaataattaattttaatgttttcatttatatgtagtgcattaaaattttacttactctgagccattaaccatggactgtaactcaatttctaggatttagagattatttcagcacagattagctttggtatttataccaggcaaaccttatcagaggcaatgcaaaatttgtaagtatacttcattcttaattggcctgatgcagcatgctatgactaagcagaccattcatagaaaatcgctctccaagttattgtatttattttctggaaaatattctttgttcattaaatttcaatcactttttaaatacaacctggtactttgacattactgttaatagcctatcttaaaatcaaacatcatttagaacaaccaagaaaaatgttttaataagcttcctttagcatcaagtgcctcatttgctctttccttctgtctagtaatacatcaagttttcaatcatttattaattcatttaattactatttgctgagcacccattatatatagggccctgccccaggtttgtttcagggtataaatgtgtaagtgcaaaacctagtcctgttgtcattgaccccacagtaagggtgacatggtataaggcaggcagcgtggtaaaagctggagtagggagaaagggcactgacaaggaatcagaatccaggagtttctatcatgaatctctgacttggggtccaagtagaagaaaacctcagtccataatagttcaaatatttagtgaaaattagtatttcacacaacatgaaatatcaaaatacggtagctctagggttgcttaattcaggggcccattagcacccttaagaacacaacttctttctattttttttttcactctattaccttttgagtattgacttttatctctctaagtagcttccttcaatattccaagatgactgacaaaatttggggcattaagagccaacatgacaacgctcaacctttagtattcaacaaaatgacatttacctaaagaagagctatctctctctctctccctttttttcctttggaactccaacttttagcaaggaaacctttcccagaagccctccagtagatatttttgtgtcctgttggcaagaaatggattatgtccccacccttaaatgtatcccttgaaatgagtttaccttgaaggacttgacttgctgcagtgacctcggctaagcaactcaatctctctaaacatcagcttctttctctacagcattttcctctagtccaggggtccccaacccctgggccatgaaccagtactggtcagtggcctgttaggacttgggttgcaacagcaggatgtgaatgtcaggcaagggagcgaagcttcatctgtatttatagccactccacatcactcccattaccgcctgagctccacctcctgtcagatcagcagatcatcagactgtcactatctcccatcacccccagataaaactgtctagtggcaggaaaacaagctcagggctcccactgactctatattatggtgagttgtataattatttcattatatattacaatgtaataataataaaaatatagtgcaaaataaatgtaatgcacttgaatcatcctgaaactattcccaacccagtctgtggaaaaattgtcttccactaaattggtccctggtaccaaaaaggttggggtccactgctctgcttctagtactacctctatgcacccatgctactgaagtcatgcacttgccaacagaatcaaagataaattatatgaaagcaattatgccagcataatgtattaggcaaatatttggcatcatgattgtatgtaatatgattatatgtaataggatattattttagggatactctaaaaccatgtacacacaagagtgggcctttgccacagtgagtttaaagtgtgttccttgcagcctttgccacatcactaaaaatgggcaaatcatattttcttaaaggaattaattgggactgaacaatggctcattgggtttgggtttcttgcctgaaaaaatatgacataaatttggtttcataaaaaaaattctgttaccttgctactcaacgtgtggtctctggatgggcagcactggcatgacctggggactggttagaaatgcagaatatatggatttctttctcactccaggaatatccaagatgatctcactaaaggatgtactgactcagaatctgcattttaacaagatgtccaggtaattcatatgcacactgacttttgtaggacaccactgttggagaatataagatttctgttttgatcccacagatattttaaatctcactatttcattagaattatgctaacattgatgctttatgaaaagagcattttctgaagcaaatagcactgagccaatttaattatttaatcaatttccttttcagagaatatttgtttccatctttcttttttatcttcataaaattatttattccatgtttcaattttacaacagagattcagttcagtcatcattttttttcatggagttttactatttaaccttctgcctctgcatttttcttgtgggcatttctaccaagttcaattttcttggattaaatttattaggtctaacttttttcaaaatatttgattattcttttaatattcagtcagtacaaaattttgctatctctggatttagtcaaagccaatcttattttcacttgattatttccaactgtaattttcaccgtgaactaaataaaatctgcttcaaatcatttaaatagctgcaactattttgatacatcatctactaagttcttaaacagaaaaaccacgccttatcttcattaggctcaaaatgtctcatgtaagaatgtatcttgtccagcactttgggaaaccaaggcaggctgatcacttgagcccaggagtttgagaccagcctggcaacatggcaaaacccgtctctacttaaaaaaataaaaaatacaaaaaattagccaggtatggtgacatgcgcctgtactctgagctgcttgggaggctgaggtgggaggatcacctgagcccaagaggcagaacctacagtaagttgtggtggtgccactgcactccagcctgggtggtgggctgagaccctgtctcaataaacaaagaaataagtaaatataaagggacatatcttgctttagctctggtgtcctttgagctcaagctagattacattagctatgttatatacaatataaagacattaccatggagaacagcatgtgtcgcttactataagagtgtctacaagttaaaatactactgaagtataagccccaaaagggtaatctatatctcattcatgtttatccccctgtaagaatctgtggtgcatcacaagtgttcaaaacatttgagttgcagagagagattacaaacacagcagtcttcaaacatatgctgtaagaattcagagaagggaagcttggtcctatctgtgtttctagatagttttcatgtactagttggcatcccttctggaaggtatagcatagttcaaagatggagatggaaatgtctagtgctttttatgggacaccatccatttttattttattttattttattttattttattaagtgtaaaattcttatgagatagccttgaaatgtaaatttgggaaaatagggacactttgaaggggaatctgagcatgctgatcagtgagataattgatctggtagcgaagtgcttattatacaggatagacagcagggagtgggatgagagagggaagtggtaaaaaactgatagtgtaattagtataaatgatattgcagaggcaatatgagtctgaactcaaaaaagaaaatctgaagtgaaataaaaagggtggatcctgaagacactttgtaatattggtgcccctgacccttgggcctcttgtttccatgctgtatgttgtctctgaggaatttaacctttcctcaaagtatttgtctactctttcctgaactgtggacaacactgaattcacttaagactgactcctgggcatttctactaccatattttatatgaactccagtgtcccaagaataatcctccacgttttttcctaaattaagatttctttttttggtgactgcattgtgaaatgtaataatcggcctcatacactactatccatgcaggactatcaattttatcatgtaattccctcccccatttttttcctgcctattcctactttccttgctttactcaggggcttattatttcccgtctgcctttatagtattttcctaactggtcttcctgtctagtgtctccatcctccaagtccattcttcacatagtagccagattaatcattctggattgcaaatctaaccatgtcaccctttgacttaaaatcttccaatggttcctaaatcttgctttcaggaaacgtagtgagttattattgaaaaggcaatatgatttagaatcagacatgtaaacttaagtcttgattctaccatacgttagtcatatggccttgagcaagctctttatctgaccctcagtttcaaaaaatttactttatctaagactattctgaaaattaagtgaaattatacacacatacacacagacacacacacacgtgacataatcaatggatactttattagaaaatgtttaaacttcaaaaaaagtccaaagttttctgataatctaaacatacaaacacatatatgtatgtatatgtgtgtaaaatatacagtcacacacatgtatatattcatgtaaacacggagtcttaaatatatatatatacatagatatactagtatatataatattgctttgtacaatctcaaacttgaataagattcatgatatggtttggctgtgtccccacccaaatttcatcttgaattcccacgtgttgtgggagggacctggtgggaggtaattgaatcatgggggcaagtctttcccatgttgttctcatgacagtgaataaatctcacaagaagaggagttccagctggatgtggtggctcatgcctgtaatcccagcactttgggaggctgaggcaggtggatcacgaggtcaggagatcgagaccatcctggctaacatggtgaaaccccatctctactaaaaatacaaaaaattagccaggtgtggtggcaggtgcctgtagtcccagctactctggaggctgaagcaagagaatggcatgaacctgggaggtggagtttgcagtgagccaattgcgccactgcactccagcctgggggacagagggatactccatctcacaaacaaaacaaaacaaaacaaaacaaataaagaggagttcctctgcacaagttctctctctttgcctgctgccatccatgtaaaacatgacttgctcctccttgccttccgcaacgattgtgaggcctccccagccatgtggaactctaagtccattaaacctctttattttgtaaattgctcagtcttgagtatgtctttatcagcagtgtgaaaaagaactaatacaatccatccatattgaagtcctaagtgtagatatatacatatttacctttcatgaaaaataatagaaataaaagcataaaaatgaaaattccctcaatgcttttatcaaagggagtattaaactttcataaggctaagttatacgttcactttgagaaatttaaccctcaaaagggttaagattaagcggataatactgaaataacagcaagaaaaacttctattatggcaggctgcattaattaaagtctgtatctacaagtcagaggcagggacatcctcacagggcactctactcaaaatgattagaacatttatggagcattgtatacaattctggagacaacactttaaaagatctatttaaaaaattgcacccagggaaagataaataagtttgctaatgataccatattctatttcaaatgcaagtacaagaaagtggcaagaaactcagaaaaactttgtttaaggaagataaatctaataattagaataatccagcaatgaatggagttatctgattgaaattatctgggtacaggctcgatgatcatatatctctaaaggtcatgcttaaatgactccaaacatcaggacttactcggatttgaatgacctaaaagtccctttctaaaacaatgatgtaattttcagacaaaaagataaatgcagtgcaacactagttatggtacaaagatacttttgtttttcttttgtgtttatttgtgcacttttagttcagaagtggtttttaaatctcctatgtagcacactttataattacacatatctttgtgtatctaaaacataagttctttaaaaattaattacgtttctcagaaagatcaaagcattgatctacatttttttcatgttcaaccttgtaacctttacttcacaaacgttaaacatgaggttaaatggtgttccttaaggagtaaatgcatcaggagttattctaaaaatgtcttgtctactaagcaaagcaattttccaagatacagttgggatatgaaaaaatcgcacaagaacatgtatactgaatttctgtttattcctagggctgtatttatactgtcataatatagaagaatttcaaacatactaatttaaatgtgtatcttaaagtaactgacagattatgctgcaatgctatacattttcagaattggtatcctagtatcaattctgaattctataatagcagactcacaggggacctaagggctgggaagcaatcacagcctagtgagtggtgttagcctacacctcctgactgccttcctctcaacttctcacacaaccttgaccgttttcagattctcccacgtcttctggcttcagtacacttctgtatgcttgactagagtcagtcattgtactagtgtgctagggctgccataacaaagtgccaccaactccttggcttaaaaaaacaacatttttttttctcacagtgctggatggaggctggtagtccaagatcaaggtgttgccaaggttggtttcttttcaggcctgttactggcttgtgaatggccatcttctctccatgtcttcacatggtctttcctgtgtgggtgtctgtgtcctaatctcctcttcttttaaggacactggtcatattagacttgggcttaaccttatgacatcattttaccccaattacctatttaaagatgctatctccaaatataatcacattctgagatagttggggttaggacttaaatatataaattttggggcgacacaattcagcccataacagtaacaaatagtaatacactaagctgattttttaaaatatgaaataagtaattgtttgacatatttttcaagctttgactggatgttttggcattaagaaattttgctaaattcaaaaagatggataataattttttactttagaaaattgtattttcagacaaattttggatacatttttgtggctgtgacttagttggtaaatctacccatgcaacacttatcaccagatgttaaggactaaatgcttagttttctttggaaggtaattcggtcatgaatgtggagtcttcatgaatggaactggtatccatgcaagaagagacacgagaggttcctctttctctgctgtctaccatgtgaggacacatcaagaagatggtcatctaggaaccacgaagagtgtcctcaccagaaccctaccatgctggcactctgatctcaggttttccaggatctagaagagtgaaaagtaaatttcctttttttaagtcacccagtctgtagtatttttgttatagcagcccaaactgacaaagacaccagacaagctctaactaaaaatgacacaaaagcttttttaataacttgaaataatacagagggatttcagtgtaatttccaatatgctggatatgttaccacagaatctcgttgaaggctccatgagccataatgaagagaagcacaaaagtagtatttgaaaagcatacttgttctcgagacaggacaaaatcagtgttttcattttcttatggaagagtttctcagaaaagaattcaggtaagatagctaaatgccattccccatttaattaaaaataaagttttatctgaaatgaattaaacacaactctgtttaattaaacccaaaacctttaagaggatcactccagtaagatcaattaacattctcttccatattgaacataattagaatggcaattcttgtaatccactggcataacctttaaaacttgcttggtctttaaaacatatgtggcatttccttaaaaatccaaacagctaaatcataaaaccacatactaagtttaatgttagtgctcattttaaaattaaaactattcataaaatagaactattaaatcttatttgacaactggtatttctgagttacttgagagttctgcatgaaaaataggttccaataggtgaaataggaaaattagatcttaaattagtgaactggcatacagagcaaatataagatgaatttgaatcatcacattctttttttttaaataaactaagtttcctgtcagggtttttaaatatttgccttaatttatgagtcacacagcttatgtagacatagcaaaattttgttaatgccaataatagtttggaagaaaagctttcattttcaagcactgttctgaaacatccaggaaaatctgaagaaacagaaaaaataatattaacatgacctttggccactgctactttgtgatatggtgattactaatgggactttttaaagtatgccttacactttcagaattatacatgatatcatttgctaccaatatttggcaatatttgccaatatgctgttatgtttctcccatcaaaaataaaatattttgaaatatgctctatatgaccagagagtggttgagaagatgtgcaaatgtaacatccaacagtgctcagggacttccaagaagtttggccttgggcatgctcaccaaggcatggtagagcttcagggtcctcacgtttgaatggcccctctgttggtttcaaaggccgtattttcaagtcttctggctgtcagcccaacaggtatacccatcaaggaatttccaagttgtccttcagactctctgctttacataatttgcttctctgatccactattccagtgtaggatgcttctctggagatgacaactcctaactcctatgctttctctactacttccatgttgcatggctctgcctcttgctagtttggtcattaatttcaacttgattatttcctgatcaagaaaataactttacacatgagaaatcaaatcacttgaccactgaggattagtaatttattttcttcatctttgccatacttaaattttttttctaacgtaacttcaaaattgttctagacaatctacaagacacatagaattcaaagatattaaaatactaggccaggcatagtggctcatgcctgtaatcccagcattttgggaggccaaggcaggcagattgcttgagctcaggagttcaagaccagcatgacaaaaccccgtctctacctaaaagaacaataaaattagctgggtgtggtggcacacgcctgtagtcccagctacttgtgaggttgaggtgggaggatggtctggacccaggaggcggaggttgcagtgagccaagatcctgccattgtactccaacctgggcgacagagccagacattgtctctaaaaaaaaaaaaaaaaaaaaaatggaaaaaagaaaagatttggaaaagaaattcaaagaatctggtgtgtttctggagttctggcacacttctctgtgagctgccagctatcacctgatagttacactctgtgggatatattaagttagtgatctggactctgagttgtatgtgacgttacactttaatatgacagttagacaacaaagataggaaactcttcagggagggaatagggggcactagctggccagtggctgtgatcaatccaggacaaagcagggcaagattctgagctcacaggaaaaactccagattgaactggtggacataatatctgtgtgtagctactgcatgtaattagaagaccaaaattttggtagataaaaaggctttggcattcaaatttactcattttaaaagagtaatttgtcatgtatttcctaaatagttgcatcaattttactaaaattagaagagccacacattgcaggtgcataattacacttgccattaaacacaaacacagatgcacacaacaaaattagatgcaatcatttcattgagaaaagaatgccactcctttctcattccacagtttttatttaaaaaattaaactaagctttgatttttctcaaagactgaaggatatgctgtgtgtgatttttttttattttgtccacattttaggtgggaattagtgatgaggttattctagaataatggaaactttatgcaacagtaggctaggcttccttcagtgtagtcatgaaaataatcactatatcacagtcaactctacatagtagacactgcaaaaaacaaatctgtcttcgacccatcttagaatggcccttgctataattttacctaccatatccaagtggggaaaaagacaagggagggtgttcattcattggttatgagcctagcagtatggttacacctttcatagatgccatcttatttcagttctacaataatcccttgaggtaatgttggctccattttttaagatgaggagtcctgggatggtgaattcatagatccagctaataaggatagtaaaatgcagagctagaaatttgaattgcagtaatttggatctagtttggtattttacctcctcacccctgggagatacgttttctctagtctaagccaggctggccatgtcactgatatcgagtctcacggtataaatcctgtaggcctaagtgagtacatttcttctagtatttggacttttagaagacaaattttatgatgatttatcttaaataaatttttctgggacattttttgtcatagactgtaagaccatactgatgtttttttaaaattgagattaaaaacttagaatgtttttcaagctaatacgactttgggaatgattaaactgaattccacatcagaattctcactagtattagtcctagtaaaaataattcattggagtatatatatatatgaataaagctttttattctagacttgatgcaactttagcggtaccagggagcaaagttcatccttatgtcattataatgactaaatcttagcaaagatcctgctgattaattcagttttctcatggtaggatcataatttcatttcccttctttccaattcttattgcacaaacttttcagttttaatattaaataatgtattttaaacttttttagctagtggattaagcaataaaaccagttacagttttaaaaataatggtgatcccttaaaattagattcatttaatccattgtaaatagttatgtgaatatttcttgaaatggggtcactcattggtataactattgtattaatattctacatttcattttactattatgcaatcactttatttaaaatggtatgcggagtatgtgggttaatgtaacaaaagttcctatcaaattgtaagaaactaaacttctttcagtttctcaaacatattatactttcttttacttcttggacttcacataagttctttctggaacttattttttaactcaatcttcctattcctacttgtagacacaactaagtcctgatcatattttaggtttctgctcaaatatcctttctcagtatatctttctgaattctcagaccagatctctggtttatgttctaagtaagtcttctaatttaccagtatacacattttaattttatttcttgtttatagctctgtgtttattggctataaactttttaagggcaggaaactattcttctgtcttcatttctggacaccagaatctagtcctagaattcatgtgataaacatctgttgcatgagtggtaagtgatactgagttatattgcaaacgtgcaagtttggttaaaaatctcataggatagtgtaacaaaatcattgaaatcagaaccaatgaccactatttgtgccattccctcctgagtaacctgaatgatgatgtgtaatgatgctgaacatccaggagacctgtctcttctagggatggcaacagggaacatggcatgtccggttcttggggcaggtatgggcagattcagtgcttctcactatgaaggattattctgcactgtatctagattagatcttaataagatttaaggtcttaatgcacaactgtagacaccatactctccttctctggattcctggcaagtatcaataagaaagacagtcatatttgtttccatttgtgtgacatccttttcactttgaaaataagaaaattgtgctccagaaaagacagatcttttgcccgagggcttacaataagttagtgacaaagttgaacctttctaaacagcaaagtcaaacctttctaaacagcatattttaagacattttgttgaagcccagtagtaccttgtcgcctctgccaacaaacctcaagcaggtgggaattttaagaagtcccgcattgagcattgatatagaggtgattcaacaagtcactagggacttgagggattctagcacaatacaattgcaaaattgtaaaaccttagctctgtgagagaactgttctcatttagagctgctgagttttaatagtcactgtattcgtattaaactgcatttttctctttcctatgtttactttctgcttgtcaagtaaaagatcaatgttttggacagagaaggtgacagggttggccaagaagattttgttttcctcagctcctctgagtgagctccatctcattcaaaaacagatcaagctaaatgtgaagcaggaggcatttactgtgctccacttcccaactgccagggcctcacaagaggtaacttcagggctgcgctgcaaggctgtatgggttctgtttgcataagggtacccagctgagaggatgagactgactgaaaagcatcctgggctgcactcatcaaggtatgccccagcatcactgatacaccagaggaaagagcacttttgcacaaatgcaccctatgggtatgaagtgacccacactcactcattatcttgggctgggatattcccttctttctccctactcagctactatgattggacctgaaagttcctaaataaagctgtgtcctaaaaagcattaattggtaactttaatgctattgctgatctccccattttctttgtagttctatgcacattttgtttaccagcagaaaaaatagtaagtttgatttactcatctttggttagaaaattgcttctactttattttggagacataaaaaagtaggtaaactgttttcaaatcataaagaaaatactacaaaataaaatagatttctctaatatgttttgcatttattcgacccatttttaaaaaccacctggaaagttaatatatttatgtgatatataaacagatttcagtatattttttaaaaaaacaaagaataaaacttcctaaagagattttatactttccatatttaaatcttattagcattttaattaatgacgttatttataagcaaacactgttaaatgctgtattttcctgttgcattttttcccctaagagttgaataacgggaagaacactgtaattccatggttatgtttctgtaaacttccatggctgaacaaacaaaacaatcaccaaatagtggatagacttttctaaaacaaagtctttcaccatgaattaaaaaaaattatttgtcattctctgcctcttgttgatttgtatgatctgacagatggattaaaagttgtccattaatgtgagcagtgagcttagaaacagcaaaaggtgctgggattctcttttcttttctttctttcttgtttttttttttttttttttttttgagacagggtctcactctgtcactcaggtcactcaggctggagtgcagtggcatgatctcagctcactgcaaactctgcctcccgggttcaagcaattctcgtgcttcagcctcctacacagctgggatcacaggtgtgtgccagcatgccaggctatggaattctcttctccatttcatgctcctgagtggctctccttacgcggtaggtcagggccagtctgcacccagcctatctcccaatttcccacctgtgttccaaatgtagactccaagtaatagggagctgggagttcttggtccctacttctatttcccacaaagcctctctaaatgatcattttgtcataaattatggtgtgcttgctctacaaacacagcttaaaggaatatgtcctacctctgcctctaccttctccaagacaattccgacaagatgtacttcttaaatcctttttacatggaacttctggactcttcactgaagagctcagctgtggccagcagatgcctgactatgtatttgcatccattacaaataccttgttagaccaggatagctcccccaagggagtacctttcaaaagaaggaaagctgggcttttaaaacaatggataatctcataaggggtgctgttgttggtggtgggatgtcccagcgtttttcactgatagttaagtagagctgctgtggaaaaatccaggggtctaggtgttttttggaatatacaaaataatcagattcaaagctagggacacaaagtgtcctgttttcttatttgtcttttgatttaaaataacagagccacatgattttggataaaacttggctccagtactactaatctctagtttctatgttaatgctaagaaagaggcagggaaaataactcacatggcacttaacatccttccaggcacatgcagcatattttataggcctgataccattcagcctttcaacagccctctggaatgggcatttactatatttctcagatgaagaaattgttgcccaggggtaaaatgctattcccaatttcacataggtagtagctatggggattaagatttgagttcaaatcctaaagactgtgttttttttttttaattatatgaatccattgagctaaaaacagctttgaggattttaaatgccatccagtgacaatttctacaaactgtagacaaaagatcccaaatgtcatttagagtcattcaggggcattcctggtaactttaacccattccccaaatagaaaatattatgctgagttcctatataataaaggctactgagttgatcacctgaatttatctgtggatccaaaggattcatctgattcccagcaatccactaaacacaggagagccagaatacaaaatagcatctttaccaccagaacgaaatagagattaaaacttttgatgtggaagtcaatttaagcatatttgcttgaaagttaataaactattagacttttcagtatctattcaccaggaatagaggcacaatgcaaaacaattacagatgagcagtctgctaaaatcattatctattgaccgaaaatcatcattatatcagcatcataacttagatcaattaaatgtaccagggaaatgaaagcaaatgagatgaagtgaaaataggattgctgaatttggcaaaataaaacaagaaatgtctatcaactttgaatttcagataaactacattttttaaaagtataagtacatcccatgtaatatttagtaagcacaaacctgcacattgtgcacatgtaccctaaaacttaaagtataataataataaaataaaataaaataaaatattcaccatttataataaatttaaatttaactaagtttaactgtatttttatctggtagtcttaaagcaaatgctatatacagttttacagggaacttagtcattctaatcaataaaataatagctaacattttcatatcagttatcctttaagcactttataaatgctaatttatttacacaaccctataaaataggtactattattcctatttagcaaataagaatattgagatagtaacagatggatttgcccattgtcatgcaactagtggcagagaaggggtttgaacccagaaggtcctgttatagagtttaacactctaaccacttcagatactgtctcctatgaaatgtatcagtgaattcaaaatcctacaaattgcacatagattgataactcttgaaaatagtattcaacaccatattaacgtgcatcatgcacttactttacccaaggcctctttaacagacagcaacagtaaacttaatattccatcttcactgatcatattttctctcttcaaatggtacttcagaaattggtaatacctcatggtcattgttcagaatatctgttattgtgttacatatatcaaagggcaaaataaaaaaattgatttaaatttcataatttaattatatatataaagggtatatatagatatataattatatatatatatattctagccagagaacacttaaattacagatacgaaaacagatcttctttctcataaattttagatttgattctatatatggatgtttaatacactttatttcctacagagataagagaaattaaagatttgttgttggatttattcatttaataaaagatcaatataagctggaatttttatcctttggatactggtaccacagaatttctttaatttggagtgtcctgatactttaatcttaaattgcaattagattaatgcttaagtaatcttcaaaagtcagtatatctaagtaagtcccattagaatgggacttcaggccaggcacagcggctcacgcctgtaatcccaacactttgggaggccaaggccgatggatcgcttgagctcaagagttcgagaccagcctgggcaacatggcaaaaccctatctctacaaaaatacaaaaattagccaaccttggtggtgtgtgcctgtggccccagctacctgggagtctgaggtaggaggatcgcttgagtccgggaagtggggtttgcagtgaggcaggattgtgccactacactccagcctgggagacagagcaaaacaatgtctcaaaataaaaaaaaaaaacacaaaacaaaccaagaggttgcctttaaacgaacatgtttcaaataataaatatccaattccttttttcttgaacatcaccttgcacaagaacccaaatatatttgtccaaaaatgcacatttctatgcccaacacagacctaataacatcagaatctctggggataaaatttaagaatctccgttttcagccagcccatgccaccagctgattctgatgcaggaggtctccaaaccatgctttgagaaaatgactttgacaccaacatgtaagaagatacaggcagctggtggtgtgctttttcccactgagatctttaaagctgctttatttttagaattttccctatttctcattacagagctttaagacagcttgtagaaaatgtgtgtgtgtgcatatatatatacatatatagtatatatatgtatatactatatatgtatatatgtatatacacacatatatatgcacacacacatatacatatacttacatatatacttatatgtatatacttatatacttatatttgtgtatatctctacctatatatatatatagatatatataaaatttagtgttgcagtctaaaggactttggattcattaccgtgtattacagattttcccacatcgtaaggcatatgcctaacagaacagatgggtcctgtggtatttaacaaagggccatcaaatcctacagctttggggattaaaaccctacagtgctttttcatgaaataaacaaagattgaacctttaataggtggtaggatgttaagaatggggtgaaaagtgactcagagtttaactcaaataatagttgttccactcatttaccttaaaccctcttaaccacatttggttttgctaattatgttgcatatagaatagcaatagtaatcatatacacccaatgccataatgataatacaaccctgaatgtaactgctatcaaattttgttccatattttattttaaaactataggacaaggtatcataaaaatagaaattaataatgtaattaataatggctataaatatcactttgcttttttttcttatgatgggtaaccttgtacaaaaaccttcttatcattttcaatagcattaaaaaatagtgcaaatggaaatttttttttttttgagacggagtcttatttgtcgcccaggcttcagtgcagtggcttgatctcggctcactgcaacctctgccttctgggttcaagtgattctcctgcctcagccccccgagtagttgagattacaggtgcccgccaccatgcctggttaatttttgtatttttagtagacatggggtttcaccacattggccaggctggtcttgaactcctgacttcaggtgatctgcctgcctcggcctctcaaagtgttcggattacaggcatgagccactgctcctggcctgacactatttttttaattgaacctattctactgagtaaaagtaaacaggcacacccctgcttcctttaaattttttttatttagaggacacaaagcatgagaggagaaaatatattggatacagatatcttgttattcaaagagcctatagtatggcttgttaaatgaggaaaatctgtaacgcaaaaaataatgatgctttcatagcagagttcctattactcaacacgtgggaaagcctacaaaatgtctactgcttatgtttggtgtcccattttaaaacggtgaatatcctaatatgtattctacattaaagtttaatgtatgtcagaacctttcattggaaccagcagacagaaatttacttattaacatagagaaatgaacatagaaatgaacacagaggaggcaaaaccaaagcatgtgaatatctgcagaaggacaaactaaagttaacataaagacaagtagtagcgatgatcctctgtcattttaagcaagagaaaacagttttaaagaaagttaaatgcagtttaagaaacgggacaaaatttttacaacttgagtgacaaataagtatttgtgtactgttgtaaacttctttgaggaactgtttctcagaaagtaaaagtgttcacttgttactttccttgcttagagtggtccatgcatatgactcattttattcatgacaggggtcgactattcctcaggtatatctgggttaactttagcttatgtgcaccattctgaagatgaaattgataacaatgctttggattcatttagataatttcaaatgcttggtttacacagatatgaacaaaaaattgatgaaattgtttgttatatgaagtaggaacagaggcacgcagtgaactggaaaaccaagtttgcggatacacatatgttgtatatattgtgctgtactgaaaaaatcatgttgatgcaaaaaaaggctgttaaggttaaaccacattctatgtgatgtcagccacaggcagccatgaaaaaatggaactcaacagaaaagggagaaactggatttttgggtcaagttctgccatttgcaggattaagtcatgtaatgtcagcaaattgtatttttcatgttttgagacagggtaatttatacaaataatatgtacacattatacatgtgtatacatatgtacacatattattagaaagatacagtaaaaaaaatagaaaagccctttgaaaacaacaaagtgctatagaaatacaatttaattattacatgatattccaaagcggttcctataggatattagggtagttatttttatttttattttttattttactttaagttctgggatacatgtgcagaatgtgcaggtttgtaacatagggatacatgtgccagggtagttcgctgcacctatcaacccgtcatctaggttttaagccccacatgtgttaggtatttgtcctaatgctatccctctccttgaccccacccctcgacaggcccctgtgtgtgatgtccccctccctgtgtccatgtgttctcattgtttaaatcccacttatgagtgagaatatgcggtgtttggtttcctgttcctgtgttagtttgctgagaatgatggtttccagctgcatccatgttaaaaagcactccatgaaaaataagttagaaaatcatcaactaaaaagagttaaacaactccctttcctacaggactcttaagagtctttactatgttaatatgcatgtgagaaattaagaacataaaagaggatatagaatttacaaaatgtatttcagcccagaaccattttttttttggaattactgcttaccttatgggagtagtgattttcaggatacatcttggaaaatgctgatacaatttgttattcggagagaaagagaatgtaatttgttttaaaggactgcatttttaggacgaaattttcctaattagatcagttcaaaatcaaagcaggaaaagaaggtcattttgaaaactgggtctgtcgtcagaagaacccaaatctcgtagtggaactatctgaagaaagggtcatctggataatggaaattttgtgttgggctagtagttttggattcacaaaaaggactaggaaccaagagctctgcgggcggtagaaagcctaaggtggatgtcagctatggcagcaagctagacccatgtgtactaagaagccagaagtcgaagtggcagcagttggcaccataagagccagggcagttcctgaaacttcaacagagatgagggtgggctgccgagaaacaaccaattacccttcagggggcaggccagagctggagtgtaaagccaaagagtagatacattagtccattttcacactgctgataaagacatactcaagactgggtaatttacaaagaaaaaaaggtttaatggactcacagttccacatggctaaggagacctcacaatcacagtggaggcaaaagacatgtcttagatggccatggggagaatgagagaatgagggccaagagaaagaggaaaacccttataaaaccatcagatctcatgagacttattcattaccatgagagaggtatgagggaaactgcccccatgatttaattatctccctctaggtccctcccacaatgcataggaattatgggagctacaattcaagatgagatttgggtgaggacacagccaaaccatatcagtagataaaccaatcaacaagcaaccagcaaagctcaggtggagaagaagtcaggggaggagagcagtaagacacatatcagaaactgtcagaagtagagggcaggtcaaatggcaagagcagcataaagattctttgactgggcctgggcaaggaacctaagcaattagttcagaagtcaaaactttggttggctttaatactaaggtcacaatctcttctagtgaaaaaaaaatgtacatctattttttaaaatataaactaattccagaaagttattacctagaagctgcaagcagataaatgtgtccttagtcacatcttaaataatctcagaaaagaattttaccaaagatcaatacagaaaaggctttgtctaggtccagaagacacactatgctaaagaattataatagcggcataaaacgaacaaagacattagacatttgaaagtcacttcactgaggcatgttttccttgcacaaatgctaattgtattaattaaaaagaaatgaatgcaaaattttctataaataaattttattttgatatcagccagcaaatcaatacttcataaatgagagacatttacaatcataaatgtaaacaaaaagtgaactacctattattatagcattactggctttgaggaaatattacaaaagtctctaggataaaccaaagcaattgagccaggtgagcttaactatgagcaagctcgctggacagagcagggttctctaaaacataatgtatgaataacaaacatatcgttgggttgtgggcagaaaatattagagtttacattcctatttcctatttgttttattttaaaccaaaaatgtaggaattgcattttccaaatatttcatacatgtgtatgtgtgtgtatccaatgctcaggagcactggaagggatatacgattgttacaatgtggcaccacaaatttagagggcaagctgaatccacagaatctgcagagcctggctggacccaccaggagctcttattcaagacaagataagtgaccagagctatgctggtcaggactgggcattggagaggcttcctaatccaacagatatcccctgaaaaaaatgagtcacttcaatcattataatagtctagaaaatactgtggtaaaaatcatctcataggcttcctgacaagtgctgaatcccctttagaccactgactggctctgcaatctttaacaagcttctctgactcttcattataaagcaaacataacttagctcacggagagggctgctttaaagacaaaatgagattactgattacaattgattctaattttatttaaaagcctttacaaatgctcataatatttgaaacagtattcccaagttctaaattttactcattggcatattttcagttcatatttttagaagagaatggttaccattcttacagctatgctttgttgctacaaagataactaatacgccacaaacgaaaattcatttgcacacacaggaatcagaagtcatctaatttgcattatcataaaacaggagcaggtctgctgtgcacatgaaattcttttaatttctgtcgtggtttttcaatggtttcaataccacttctaagcagaagcattcaacatcctacacttctgtttcttgcttttggaattttgaattaatgacaattatggcatcagtaatcatacatgcaggcagacataatactgaatatgtctttcagttccttgcacctgacattgtgttttgttataacaggtgccccaaatatacttattttaattcaaaaagtataaagtcatttaaaataacctccaaaccataaaggttccatgcattttttaatgtaccactagagcttgtctttctgagattgtaccctgtatctggggttaatctatttccttctctttggcaccagaaactattactttgggcctttttcatgattttctatatgcaagcacttacttattaaatattaagtaagtatttaataatcacttactatatcttacttccttgccttatggaagtttttgttttctaagctgtttttagagagatgtaagatactaaaccaaataaatgactcaaaattagaagggatggaaaggtaggggcaatattttgagtattaagtagatgtgttattcattgtataaaagttaactttttataggtctatttgaaggttagatggctatatctgtatcaataattgttacatgactttttattagcttcatacttgtgctaccttgtgaagaaattagctggtgtcttgataattttctgatttctttggattcgtccagtcatgatttagacaccagaattttacttgtgtgaggaattttaaaaggagaagataggctggggctgatctttttttgtagtatctccattttacataaaaaaagaaagaatattgaagtctcagagtattgatataatttgtcagccctcacatctatattttgtacctcaaattatgcactccttatactacattgatattggctgcacttttgtttgcacttaagtattttctgtacaaatgtcctttcaattttgttttgtttataaaaagttcttttttctaattggatagtggggattccctttgacatcataaaattataaaaatcaaaaagatttcttattcatggtatgtggtttaaaaaaatgaaaaaatacataaagatgacttatagtcctaggaaagtgtgagcatccttcgattcacttagcacactccaacatatgtcaatactatagaagaacggaagctgtctcacaatcatatacaagtttcattacttgacctcttttagatcttctttataggtgaaccttcataaatgagaaatattggaactgtgatttggaaatcagaataatccttcatattgacaaatgtttccagtggcctggtggtcacttaattttgaaaacctttcctttagttctcctgtaaataaattgttcagaaggcaaaataagttaatgctttaatgaagttataaattttatgtctagaatactcccttttaaaaatctgacatggactaaattaaataaggcttatttaatttgaaagcttaaattcaattgatttcttatacattttcacaaaattagtattgaaatgaaaatctgtagggtcagacgcaattttgataaaggtcaacactaaaatgttcagtctaacaactctattaattctactaatttggttgaaatactatgcagactaccttaaattagcaaatgtcttatgaaatagaccaaaagatcatttcttaggtgggattgtgacattttccttcctgttagtcctttatattatgttaccctttatgaaatctgaaaaacgtttagtagatttaattatgaatagtaaattatccattttctatagtcaccaccaatacggcaatgaatacatacacaatgtattcattataacaaaatttgtagtattttactttaaaataagtttttagttaatccaagttaattctttgagtgcagtttgtttagttccgtgaacaaaaccaaaatgaatcagcatatttcttcacaattaatagcatgatcattagcaatgtccctgctcctcatagaatgtctttaagcatcttaacaatgtttaatttcaatttgtctaatctgagcagaagtaaaaaagaaattaatctttctgttgaaagccagtgataacagacacaaaaacacataactgctttagtaaaaatacagtttcagtagagaagattggcaaatgataaattactcactttaaattattactactgggtaaagaagctgaaaaatctgatgctacctagatatagacatttcaaagtttttatgtgccaatgccaatatatataatttatcaacacaacctacagtttgcaatgatttaacaatgtattattttacatttcattattttattggaaattccattttggaggaatatatatgcaaatcttcacttttgattaaaattggtggtgtcaaattctgttctcctgaggtacacaatccaccagaaaggaaaagaagggatctatccaatactgagtacctactgcatgcttccactgttctgttatttgttttatttaatccactttaagagtcatcacaatttctgacttctttgtttggaaactacctatggaagctaatagtcttaacctaaaaacatctctgtgagttaaatgttactttatttttataacaaagattaatatctatcctaaccatgagttaggaatgtccaattaggagtatggaataattggctcagaatgttccaatttcaacattggtaagaattttgaaagttaaaaactaaaatttgacctttgggaggctttcagataacacattggtaagctttattgctcaaagtattagttgaattttaaagttttacaaaccatcatacacagaggtctgagaaatgcctctgtttagggctgcctgaggccctcacacatttttgccatgtcccgatagaaatagcataacaattttatgattagcagcaactcaagaaagctaaccaattaggtaggatcacctcttaaaaaaaatcacacggccgggcgcggtggctcacgcctgtaatcccagcactttgggaggccgagacgggtggatcatgaggtcaggagatcgagaccatcctggctaacacggtgaaaccccgtctctactaaaaatacaaaaattagccgggcatggtggcgcacgcctgtagtcccagctacatgggaggctgaggcaggagaatggtgtgaacccgggaggcggagcttgcagtgagtcgagatggcgccactgcactccagcctgggcgacagagcgaaactccatctcaaaaaaaaaaaaaaaaaaaaaaaaatcacacaagaatatttgcttgagaagttccagacattttgatcttatagaagtgagtagatgaaacattagagtaataaaaacaatagaatgttaaaatgagatttgaggcagttccaacatggcagaataggaacagctccagtctacagctcccagtgtgagcgacacagaagacgagtgatttctgcatttccaactgaggtaccaggttcatctcactggggagtgtcagacagtgggtacaggacagtgggtgcagtgcactgagcgtgagctgaagcagggcgaggcatcgcctcacctgggaagtgcaaggggtcagggaattccctttcatagccaagcaaagctgtgacagacggcacctggaaaatccggtcactcccaccctaatattgtgcttttccagtggtcttagcaaacggcacaccaggagattatatcctgcgcctggctcagagggtcccacgcccacagagcctcgctcattgctagcccagcagcctgagatcaaactgcaaggcagcagtgaggctgggggaggggtgttccccattgctgaggcttgagaaggtaaacaaagcagccaggaagcttgaactgggtgaagcccaccgcagctcaaggaggcctgcctgcctctgtagactccacctctgggggcagggcatagccgaacaaaaggcagtagaaacctctgcagacctaaatgtccctgtctgacagctttgaagagagtagtggttctcccagcatggactttgagatctgagaacggacagactgcttcctcaagtgggttgctgacccctgagtagcctatctgggaggcaccccccagtaggggcagactgacacctcacacagctgggtacccctctgagacaaaacctccagaggaacgatcagacagcaacatttgctgttcaccaatatccactgttctgcagcctccgctgctgatacccaggcaaacagggtctggagcagacctccagcaaactccaacagacctgcagctgagggtcctgaatgttaaaaggaaaactaacaaacagaaaggacatccacaccaaaaccccatatgtcaccatcatcaaagaccaaaggtagataaaaccacaaagatggggaaaaaacagaatagaaaaattgaaaattctaaaaatcagagcacctctcctcctgcaaaggaacgcagctcctcaccagcaacggaacaaagctggacagagaacgactttgacgagttgagagaagaaggcttcagatgatcaaacttctccgaactaaaggaggaagttcgaacccattgcaaagaagctaaaaaccttgaaaaatgattaaacaaatggctaactagaataaccaatgcaaagaagtccttaaaggacctgatggagctgaataccatggcatgagaactacgtgacaaatgcacaagcttcactagccgatttgatcaactggaagaaagggtatcagtgactgaagatcaaatgaatgaaatgaagcgagaagagaagtttagagaaaaaagaataaaaagaaacgaacaaagcctccaagaaatatgggactatgtgaaaagaccaaatctacgtctgattggtgtacctgaaagtgacggggagaatggaaccaagttggaaaacagtctgcaggatatcatccaggagaacttccccaacctagcaaagcagaccaacattcaaattcaggaaatacagagaatgccacaaagatactcctcgagaagagcaactacaagacacataattgtcagattcaccaaagatgaaatgaaggaaaaaacgttaagggcagccagagagaaaggtggggttacccacaaagggaagcccatcagactaacagcggatctctcggcagaaactctacaagccagaagagagtgggggccaatatttaacattcttaaagaaaagaattttcaacccagaatttcatatccagccaaactaagcttcataagtgaaggagaaataaaatcctttacagacaagcaaatgctgagagattttgtcaccatcaggcctgccttacaagagctcctgaaggaagcaatgaacatggaaaggaacaaccagtaccagccactgcaaaaacatgccaaattgtaaagaccatcaatgctaggaagaaactgcatcaactaatgagcaaaatagccagctaacatcataatgacaggatcaaattcacacatacaatattaaccttaaatataaatgggctaaatgctccaattaaaagacacagactggcaaattggataaagagtcaagacccatcagtgtgctgtattcaggaaacccatctcacgtgcagagacacacataggctcaaaataaagggatggaggaagatgtaccaagcaaatggaaaacaaaaaaaggcaggggttgcaatcctagtctctgataaaacagactttaaaccaacaaagagcaaaagagacaaagaaggccattacataacggtgaaggaatcaattcaacaagaagagctaactattctaaatatatatgcacccaatacaggagcacccagattcataaagcaagtccttaggacctacaaagagacttagactcccacacaataataatgggagactttaataccccactgtcaacattagacagatcaacaagacagacagttaagaaggatatccaggaattgaattcagctctgcaccaagtggacctaatagatatctacagaactctccaccccaaatcaacagaatatacattcttctcagcaccacaccacacctactccaaaattgaccacacagttggaagtaaagcactcctcagcaaatgtaaaagaacagaaattataacaaactgtctctcagaccacagtgcaatcaaactagaactcaggattaataaactcactcaaaaccactcaactacatgggaactgaataacctgctcctgaatgactactgggtacataacgaaatgaaggcagaaataaagatgttctttgaaaccaatgagaacaaagacacaacttaccaggatctctgggacacattcaaagcagtgggtagagggaaatttatagcactaaatgcccacaagagaaagcaggaaagatctaaaattgacaccctaacatcacaaataaaagaactagaaaagcaagagcaaacacattcaaaagctaggagaaggcaagaaataactaagatcagagcagaactgaaggagacagagacacaaaaaacccttcaaaaaatcaatgaatccaggagctggttttttgaaaagatcaacaaaattgatagaccgctagcaagactaataaagaagaaaagagagaagaatcaaatagatccaataaaaatgataaaggggatatcaccactgatcccacagaaatacaaactaccatcagagaatactataaacacctctatgcaaataaactagaaaatctagaagaaatggataaattcctcaacacatacactctcccaagactaaaccaggaagaagttgaatctctgaatagaacaataacaggctctgaaattgaggcaagaattaatagcttaccaaccaaaaaaagtccaggaccagatggattcacagctgaattctaccagaggtacaaggaggagatggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaatactggcaaaccaaatccagcagcacatcaaaaaccttatccaccatgatcaagtgggcttcatccctgggatgcaaggctggttcaacatatgcaaatcagtaaatgtaatccagcatataaacagaaccaaagacaaaaaccacatgattttctcaatagatgcagaaaaggcctttgacaaatttcaacaactcttcatgctaaaaactctcaataaattaggtattgatgggatgtatctaaaaataataagagctatttatgacaaactcacagccaatatcatactgaatgggcaaaaactggaagcattccctttgaaaactgccacaagacagggatgccctctctcaccactcctattcaacatagtgttggaaattctgaccagggcaatcaggcaggagaaagaaataaagggtattcaattaggagaagaggaagtcaaattgtccctgtttgcagatgacatgattgtatatctagaaaaccctatcatctcagcccaaaatctccttaagctgataagcaacttcagcaaagtctcaggatacaaaatcaatgtgcaaaaatcacaagcattcttacacaccaataacagacaaacagagagccaaatgatgagtgaactcccattcacaattgcttcaaagagaacaaaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaatagcctgcattgcaaatcaatcctaagccaaaagaacaaagctggagacatcacgctacctgacttcaaactgtactacaaggctacagtaaccaaaacagcatggtactggtaccaaaacagagataccgaccaatggaacagaacagagccctcagaaataataacacacatctacaactatctgatctttgacaaacctggcaaaaacaagaaatggggaaaggattccctgtttaacaaatggtgctgggaaaactggctagccatatgtagaaagctgaaactggatcccttcctcgcaccttataaaaaattaattcaagatggattaaagacttaaatgttagacctaaaaccataaaaacccgagaagaaaacctaggctataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctacagaatgggagaaaatttttgcaatctagtcatctgacaaagggctaatatccagaatctacaaagaactcaaacaaatttacaagaaaaaaacaaacaaccccatcaaaaagtgggcaaaggatatgaatggacacttctcaaaagaagacatttatgcagacaaaaaacacatgaaaaaatggctcaccatcactggccatcagagaaatgcaaatcaaaaccacaatgagataccatctcacaccagttagaatggcaatcattcaaaagtcaggaaacaacaggtgctggagaggatgtgaagacataggaacacttttacactgttggtgggactgtaaactagttcaaccattgtggaagtcagtgtggcgattcctcagggatctagaactacaaatatcatttgacccagccatcccattactggatatatacccaaaggaatataaatcatgctgctataaagacacatgcacacgtatgtttattgcagcactcctcacaatagcaaagacttggaaccaacccaaatgtccaacaatggtagactggattaggaaaatgtggcacatggaatactaggaatacaccatggaatactaggcagccataaaaaatgatgagttcatgtcctttgtagggacatggatgaagctggaaacatcattctcagcaaactatcgcaaggacaaaaaaccaaacaccgcatgttctcactcataggtgggaattgaacaatgagcacacttggacacaggaaggggtacatcatataccggggcctgttgtggggtggggtgaggggggaggtataccattaggagacatacctaaggtaaatgacgagttaatgggtgcagcacaccaacatggcacatgtatacatatgtaacaaaccttcacattgtgcacatgtatcctagaacttataaagtataataaaaaaatataaagaatgttaaaatgagatttgaatacatacgaattcccaaaggacacataagaatttcttaaactatatgacaattaggcatgagggtattttggggggctgaatttacaattgtattgccagatatctgattaggttttagaaaaacctattaaacagaaataaaactccattagagcgtcacatttttagctggtatataaaagacattttttaaaaaaatagcaagagattgataatgaaggaagggaatttaagtggcagacatggcttttcttctgaagagctactgctcagaactgatgcattttagttaaaaatatacctaattcagaggcgtctgattttataaatacattcaggataaaaattgacctctatgttacctctatataaacaactgaaaaagaaaatcaccccatacattgttatctatgaaaatgttaatcttattttcaacagaaacactaacaagcataacaatatacagttgaacagattatattctcttgaggggaaaacactaaaaaatagtcacaattctgggcctttttcttgcatgatgtcacaaaataaataaataaaaggaaaagatgtcaatttactttgccttggagattctgaatatgttttgatacaacaaaaattagacatatattagaagaactactccttgaattaacacaaagtctattatgaacacaatgaatcaattttagcatgcaagtgattttaagaagatagttgaaaaatcatcttgaacaaagtgatagatggaggctcacactgaagattatgccctgattcatgtaaaaatatttgtttaatttttatctttccaaagaaatatgccatttgcaatccctttatgtggatgtttctagagtctaccaacctcctgagctacttatggggtgtaaaatagtttgccttattccacacagcattatgactcacaaataacattagcgatacgcagccaatctgatacatgactggaatatttacaattttagaatatacagcaatgaaaaattttaagttgatcattgtcaagtctaacaagtggaaaggagattttcttcaaagtaagaacctgaaaacttcaatgatggctatatattataaaaatttagtttccttatttaaaaaaaagtcagctcttcaacaagaaattttaaatgtatcttttaaatattgaaaaattgagaatatgtaccagttggcctcttaaattgggtatcaaacttatatgctatgttggctcaaaccaataacttgaattattttttgaatgaatcattcatttattcattcaacaaatctttatggaatgcccaccatgtgttaggttagttagatgctgaacaacaagttaagaaagtcaggacaggcatggtctcagcctcttgaaacaaacagcctagcataaaaacacaatttccaatacagtaagaaaatggtatagtgacaaaattacagacgatgtagtagtatacatgataaagatttaagtcagacgtgggcagaatggatttggcagcaaaatattcccagagaaaggtatatccgaactgaagctgaaggatttaaatataacagaaggcagataatgctgtgggtagaggctctttccattcatttcttatagcaagaggacatttataaaggaatgggaagaaggagatagtacttggtttgagtacaagcaaatttagaagagtagggtaagaaacgaactggggccaaatcatgcaaaaaactcttaggttatattaaggaacttgcacattattctgaaacagagggagtaatgaagggttttaaacaggagagtaagagaatcatatttaccttttaggaaaacacagacacacaaacacacacacacacacgagttacaactttagaaatgaatttttaaagagtaaaactagaaacggaaaagctggttaagaagcttctgtgaaacccaggtgaaagagggtggtagcactggtgatagaagtagcagtggggatggtaagatgggaaatgattttcagatatttgagtcattttttcatagttgaaattaccaatacttgctaaatcagttaatgttagtgtgtggagctggtgaaagagatgttagcaggaagataattgggagaagaagtgtgaccaggaaaggacattgggaaacatctgctacgaggatggaggaaaatagaaaatggtgtaagctaagtcagataacaggaatattttaagcaaggggtaatatcttaatgtcttaagcaacagtgtgttgctcacttatatgtcatcactacttatcatgttatatgatgctttctaggttcatcacaaacatttgttaaataaataatttaatttagtaagcactgctacttataaggttgggtgctgggatgatatattagaaaacatactccttatcttcaaaaagttcatagaacggtaataggagaaagacttacattattacctatagcatgtgctagctaatgagagctgaataaagctctagatcaataaaaaatgttaagggaaagtaaagaaaaaagtgagtatttctacttgtgagtataagaaaaagtaaggccaactgaagaaaaaactgaaaaaagaagcctgatgtgggggcttatgcctgtaatcccaagactttgggaggctgaggcaggaggattggtggaggctaggagttcgagattggcttgagcaacacagtgagacacctgtctgcacaaaagaaaaaaaaaattagcggggtatagtgatgtgcacctgtagtcctagctatttggtaggctgaggcaggaggactgctggagcccaggaatttaaggcaacagtgagctatgattgcactactgctctctagcctgggcaacagagtgagccctgtctcaaaaaaggagaggagtggagcagagaggagagaagagaagaggaactattgcaaatttcaggtaacctggtaagaacagttacagatttggcaaatcttgtttgataggggtggaatttgctattttaaattgttttcatgatttctgggaatgcaatgaactactatagtttttaaactcatgaatacagcataaaaatcaacaagaacagaactcgtatctttcactataaagtgatctcattatcgaattgagttgtcttactttttgccacagaagccactaacaaacctgtgcatatttaaacgtgctccacaaataagagaatttcatgaagattgttttaaaaagcactgactgtaaccttacttcatttgcaaatgataaactctgcagtatctatggtttccttctataagcaagatctgttttgagaatgtaatcaaatatcttcattgcttagcaaccacaggtaaggagctaatatgtcatgagtcatgattctacgtgaacagtttgcaggtcagtggcatgatttcaatgccctttggattcttgctgtcatgctttcaaagccaatattaatacaaagtattagaatggatgagagttaagatgcaaatgctctcctaatcaatcaattgacatacacatagtgtgatctggtacagtctcctgcatcaagcttacactagcatctataaaccaacaccagcgtaaaaatagcccacagacatggtttcataaggaatttgtgttttaccaatttagttaaaccgaagatgaaggcacatttaaattagcgtgaaggtaacgactctgacactcacctaatcaacaggaaatcttctaagaaagaggaacagtgggtagtgaaacagttttggaaaactttacctgtaaccattgtgactggtcattgtggccagaggtccaggcattcactttgccttgcttgtccagccgagctttccttggttcccaagtgaacatgtccatgttgagcgttctgaagatgctggaggcagtgatctgatagtcttgtatatgtcctgatttcatacccagaggctcagaacaacctgaaagaaaatgagaagggctccatgagaaaaataattgatcacctggaacttttctgcattcattttggataggcaagagaagattaaacataatgctattcattcctccaaagagaaaacatctaaatccaaaaaaaagctataatcagaaataaatctgaaacaaaatcgaaaaacaagatagtcaattcaagctattttgtctgaatatattttggaaaaattgaaaacaagacagacaatttaaactacttttctgtgatagatgattctgcaaaatgaaaacaatgctgaaatgctctctcctgtctcattactggaggcctcctgactgctccccagttttcaacagtttcattgtgtctttaaaaatgggacattttctcacaaagtattgtttttcttttatttgttttcaaattactgcaaatgaaaattccctcagtacaaagtcattttcacaagctgctctactgctgtattctaaaccggacagcattttgtttttcaagaaatatgttaatcttcatcactgattcttatagcaccaacatggcttcttctgtaagagaggaatctagtatttactgagggtatgccatgtgccaggcattgtgcaagcataatttaaactaatagataacagaagataataagataattctagcaataaccaccactgaacaaaccttttaatacattattttatttcaatcatattcaataacctataaagtttagatatttttgtaagattctcaaatctaccacatgtatttttgagtttaatacggtaaaaattttggcttgcttgtccttgaaaaattatatgcatgcacatatgtttgtgtgtgtatacatagacacaaaatttcccagtcttggattgcaactgtgacaaaatgctctttacaatttttgtaatagaaagcatgattctatcatcatatgagcccggggctgagtcttctttatgtgaaactgttaaattttggtcaagtaactcacaaggtaagtttgatcatcaaagaaacaaagatgacaagaggacactcctccaacccaatactttctcctcacactctactgtctcccatttcccagctgtgtagccttgccctgttatttaacaactttctacctaaattttctcatctgtaagatggtgataataatagaaactacctcaaggaagtattctaagaaattacttaataaacataaagtacttagaaacagtgctggcacacagcattcagtcaatgttaactatttgtatgatttctgtaaaactcatcccaacagatggcaatggtaagtccccaaatatcagcatatcaacaagtactcaataatatttaattattgggtacagtttctaaaactagaccttttttggagtctaaactataaaagaggtgctttagaactcttcattgatcaataactcttagctataactaattgccttctgtcctggtctatctagattacttctaccttcttgaggctccccatatttcccttcacctccaccatctaggaaatgcatatcctatgaaaacatggaaaacatgacatggagggctgtgtgtcttaacacgagtacattttggtataggagataagtatctgaagcctcatattaaagatagctgtaatgcctacctgtatattctgggtgaaaaaaaagtcataacaattctctaagagtctagaaaattctaacaggcttaatggcaagctgtttatcttcaggaagttagtttcatagtggcatgcattgtctacattgaaaaattctgacttgttcttttatccccatctttgcctctacctgcatcccaccccccaagtctttgaaaactttgctcagtttgcaggagatacaagggaagaggaaagatagttgtttccctccttttgtgatataacatagtattgaagtactggatagaaaaggaatggctttactttgaccacttctgcttagccaaaaaattcactttatatccattctgttgtctagtatttatctcagaattgccaaattattggttcatagaatgaatgaatgagtattcctcctctaattagggtcataatctattttattccaaatatcttaagtcatacttctttcagtgtatttaggagatgatcttcaaaagtgtttgagaagagattacctgctcatcttctaggcagggtgaaagattttaatagcaatttactgaatacaataaggctttacagtgttccactggattgtggggagtagtttggtacattacattagtgtttatttccaggtgttacagctaacctctctgccaatgtgcctcatgccacaaattttacttcttatccatatgatttcaagcatataaattaattaactctcttaccagtgtggccagcacttgaacaaaatgaagtattaacaatgaaatgggtatttctataatgaagtgctctagttttttaaagcatccattgagagatattactctctgcatgcaagttcaaaatcaatttgctgtgctgggagatgcagcactgcttctttttgagaaaataaaacctgtaaagtgtcaggtgcaatgtcttgtcaaacttgggagtaaaatatattcacatcttaggggtgtaaccgtgccatgtgtgaaagactgactctcatgaatcaaaagactgaaaaattgtggaaggtgatgttaagcaactaaaaaccatgtggcttgcagcagatctcatcatattgtggcttcctcttgattgctttatgataaatggcttagggatgacactggtctgtggtgatatagtgagatgcaatacaaacactgtatagcaataagtctgctaagatttactggatcttaataactggagtaaacaaactggattaaattgccaaaataaggaaaatatctctgttaggaaaattaatggtactaaagcaaatgttggttgcttcaaaaaatacaccaacatagaatatgaaaatgtgattcttaaaataggctcacttgactgtacaaattactttaattcttaaaatgtattgggcttattaaaaattggctatttaatagtaaattttatttgcttgaaaatcaatccttttttaggcaacacaaataaatttaggaagagaaacagatataaagtatgcgctttaacctataggcaacctcttgaaatgaataaaaagctcacagttgtctctttgcagggacttgttctcctatttttaattaagtggtattgttttagatttggtaaaggtttttcctcacttcagggttacactaaaaagcggagcacacacgcacttttagttttcttcacagttatttgaacaaaataatttcaggccactgcagcaaagatagtttgtaaattgtgatgccagaaatgtaagaacaactaccaaaaatataacaagtgaaatgcctagatacaattttctatttcattcagaatctagctatattgaaatggggccactgtaagattcacacattaagtcctcatctttatagctaatattgatgttcctgggggacaagaattatttaactctgagtcctttgataggttatccttgagttggataaccactatttttacaataaacaggttgctagctaagaatgatccaagaatgaatttatattagcaatcttggtattgaagtattgaggaatgagaaattaaatgtttcataaaacctaaaaaaaagttcttatggtagacagacaaagataaagttcttatgatagatggacaaagataaagcttacttttctgtgttacatagcttaacctttactgcaatttatgaggtgggacagattccagtttttactaaactttttgtcggaaaacatagatcacagttattatgcaaaacaatgagacacatttaaaagtgacaattttcccgtgagaattccctgtgctttctttgaccactcaacaaaacacattactctttctacattaattctaccctgtagcatgttttagaacttgtttattctatacataaacacacactggttttccctgaaccatgttgtagacatttttccccagaaaaaaatttctatggttgttgaatttgtaggttagtaacaggctacatacaaatatgctttttgttttctttaaatagaatacagaaatagttaatttgagacttacccgacagttcacagccaagaagttccattcgcaaagtgcaatgtcttcgacaaacttggggatagagtcttacatactgagcttttatggggggtgtgaaagagttagcatatggagtgttgttatcaatgtttccacgaaacacctgtgtaaaaacagtttaaaattattcactgcaacagcttatttacctatttttacatatttaccctatctataccttatcgaaaataattgttcgaagaacagattacattatttgggagcatggagcatttgagaagtgccttgccatgagcactgaatataaaacccaaccataaactcctaattaaagccataaaccactgtggctcatgacatgatctatattccactgtgatggtcttgtcaattttaaggccagtctttcagaaccagggcagcgctcttctctttttttgagaaatggacaccttaaatccttcaatttaatctgggactgtctgctcattttcctacttagtattcatacttttgggggtagaatccagtctttgctactgcttccggatcatccagtctctctaatgctatgattagatttatgatgctttaaggtttgactcatgaagattatgtcttcatcaaccagtcccatgtacttggataatagaattccttattaaaatttccagctaaaaactatgtttgcctctaaaattcaagtactataatgtgtcattgtaaattcattaaggcttattcttattttaccttttatgtaaacctgataatccaaaaaccttatttaaattcatttaagggggtaattttaaaaatattttatataatttattagagtctggtataatgcctgattaaatggaatgatctccagtcctgatatttttaaaattaaaattttcgatgaagaactaacaaaagaattgagaatatcataagaaaagaaaaggaagtattgaatataatattcaatacctctaaaatattttattttgctaagtaacaaatctttcttccaatatgaagcatataaagatatatatctcttctatcacttagtgcttttttgcttttaagaaaatagttttcattaatataatagttatctcattaaggagtgcgttaatcagccgggcgcggtggctcacgcctgtaatcccagcactttgggaggctgagaccggtggataaggaggtcaggagatcgagatcatcctggctaacacggtgaaaccccatctctactaaaaatacaaaaaattagccgggcgtggtggtgggcacctgtagtcccagctactcagaaggctgaggcaggagaatggggtgaacctgggaggcagagtttatagtgagccgagatcgcgccactgcactccagcctgggcaacagagtgagactttgtctcaaaaaaaaaaaaaaaaaaagtgcgttaatcacgaaagcaataaaaatgtatcattaaaataaagcttaattgtcatacaaaagactgtgtccacctgtgtcaaagtatttgtagcaccaccaattaaaatctgtgaaaatcttaaatgtcagccattttaagtttataaactggagaattactacttccttcatcacactagcccaattaaaaacaagacgcattggtaatttattttcatcaacataagtcttctcctgaagaccttgtcatttgataatcaataattatcaatgacatttttcttttaaattaagtaggttaaattattcttaccatgtcttcattggtgcctttcactttgtacattgcccaagtctttccatcattactgtaggcaattttgtaggattttatatactctgggcttccaatcctcttggctccttgggtaatcacaccagtaactctcattttcctttgcaaatttatctgaaaagacgagcacaaccaacaataatcttattgttttcaggataacaatactgaaaatacgaattttagaaatgaaacattgttaatgcagattaataataacataaaaagctaataattttcatggataaatgtttacaataggcatatattaaatttagcttcaaaatccctttctgtaatggaatactatttttaagtaaacaaatatttgtgaacaggctttgaaaagggcaatgtgccccaaaaacataagtatagaaagcatctgcgttctcacgatatgcagatgtaacttaataaactgaaaacttggaatattctcttgtcaaaataatctcagtgtcattactataaaactctattgtcaacataactattaatgtgtataaactgatttaagcttctagaaatttccatttacaataaaacatgacaatttcactgagatctttgaataccagaattttaaaaagtaaagacaaaaatgatgtccaaaccaaaaacaaacaagtatcccttaagtttctggatctttacactgtagtctgtggagcattttttaaaaaaattaaatgattgcttttttcttcattttattataagtaaaatttctaactggaattttctgtctccatattttctccccattccaaatccctttacaacagtttgcttcaggagtaacatacatcaaataaaattgttaatattcttctcatgtttaatagagatatctttttgacacttaacacttaataactaaatcaaatgctacaatgtagaaaagtgccttattcatatatagtaaacattaaaatttcacatattgtaaacattaaaattaaaatgcctttatgatgtctataaaatcttttaaatgttcttgataaattgctataaatcaccctctccaaaaatataaattggaaaaatttaaatatgtcataccataatattaagttaatgattcagatattattttccaaagaaaatcagaaaatcttcagattcatgtaagtgattagagttttccactgtaggaggagactttgagagttagcatttgaaatggtccacggtgtgcatgatgaaaactgccaccctatcgccattgtttctgagtctcccaaagtctcatcttccccgttgaaacctcataaaatccttccctcaactatttcccacaaggtgattctcagtcttgttcatatataaagaaaatctggagttttgatgagtacaattttttgtgttaaaattctgggccgatggtcccttttttccttgaacaatgctaagtggatggactcagatatccaagttaggttttctcattttgatgttcagacatcacacaacaactataaccatgagtacattttaagtcccattcctctttggaggttcaaaaagacaatatccctcatgaatgtaaattttacttactactcttaatatttatctacatttatctccattagtcctttaaagattgattttggagttttaactatgcaacttgaaagagggaatgtttgaaagatgtttacttcagtatgttaggtcaattagcacatcgctatgaaagagtcatattctttcattatcttatgcatgacattttctttttttttaatctgagactctttgtagtttaaacatttccaatacatacaatatgcacagtggacactttgaatcatgttttctcccattttggaagccaagtttcacatctgatgttgctgaacattcctttttcaattatcttttatctcatttcaattatcttgtttatacctgttgtagacagccaaattatctttgctagagttttggctcataagctatagacactaattttctaaagctttaattgtagatgcataatagtttgtatttttctctaaatcattaaaaatcatgtaaaaattctctttgctctaatatttagaagctctgcatatatattttaggaagatggaactgcagttagttaagcatcacccagtttgggttgtgtctaacttttagtagatatttgtaattaaattttggcactgtttccattaaacacaaaattaaaatgaaaaaatttataaaaatacaggctcaggctcactaagttttagtaattacaggttttaaacttttgacttttcatgtatctagcactattaagcttggaaaataattcaatataaggaagctaagctgtcaccatcatagtcatactcaaatttaataccagtaaactatgttgctataggaaataaactaagtaagccttggaggaaatatatagtatgattttggaaacacctccacttacaagtatctgcaagtaattcctttccatcccattccaacattattttgtgatatctctgtaaaataacaatggctaaaaggtgatcttaattttattctccctgtatgaactatcccacatactatgtaaaaggtctattgaggattgcatcagaaatgcctaaattattctctatgagcttggtggatgcctgaaaaggaaataaaatattttcatttatgtatctgatttcagagaaattgttgttccactgggtggtaggaacactgtgtatccttaaaaagcagaagtgcattctaaggtattttgaacaaatggtagcctcctacattaatataaatagaatgataatctgaatctagaatgcttagaacatatgctaagggtatgcagaagggaggaatggactaatgggggtttcagtcttggttttgtcacttccgacctatataatcttgaacaatttgtctaagctttttgaaatttaatttcctccctgtaaaggaggttttaataaaatatgtgaatattatatgatatgtgcatgtaaaacattaacaacatctgccacctagaaagcacttagaacatgttttttattttaagtttttggtttttttttacatgaaaaagagcaaaaaagcattttctttacatcttctgcctttaaccactcaatgccagaaaatttggattttgagaagtgtattataaaagccgataatcataacgatatggggtggcgacagggaagtgctgggaggagaagggcagggaccctggcgagcgttccaccctcgggcctgtgcccacggatctaggtgaggacaaacactagtgttttcatgcccaaatgttgcattttccaagagcacctgtcccgccacaccccatcctgtgcctgtaaaagcccccagaccctagtgggcacacacacaagcagctgggcactgagaggaacagaccagcagaagagcacacaggtggctggatgtggagaggagcagaggagcagaagagcaccaccgacaggcaccggtagacgccagcaggccatcgacccatggaatgatgtggataccaaggggaatttggccaggacagttggaggagagtcctgccgctgagcagcccaactccagaggaagaccaccttcccactccataccctcctggctccccatccacctcactgagagctgcttccaccactcaacaaaaccttgcactcattctccaagccaacatgtgatctgatttttccggtacaccaaggcaagaaccccgggatagagaaagccctctgtccttgtgacaaggtagaaggtctaattgagctgattaacataagctgcctacagatggcaaaactaaaagagcacactgtaacatgcccggtggggcttcaggaactgtaaacgtttacccctagaagctgctgtggggtcagagcccacgctcccaatgacctgcccatctgtctcctccccctaagggttttgcacagtgagacactgaagaagggagccacatcccatcacacaccttgcaagggggacaagggaacttttcccgtttcaataacaagcatataaagataattttgcaaacaactttcaaagctatatactaataagacatttagggctactatggttaagagtgtgtgtgtgtgtgtgtgtgtgtgtgtgtgtgtgtgtgtgtttaaatctaatcatgagtcttaccatggggggtgggattaatgggttcttgacaagacagcaactagcatgggctactggtcctctctactgaatccagcacttaagatgccctggaacagaacattgctgagcaggctttgaaatttatcgtacttgaacacaaaaactatggtaaagccttagtgtaagtggaaatttgagatcccagtgtatgtttgtgtagctggggtttattgagggtaactccaagggctcataaaggttatcaggcttgggaagaactttctaaatgttctatttctctttctcattctcattttgcttattgagctctttctgatctacccagttccagcccactgccagtgagaagcagtggaaaaatgtgggccaggcttagacaggagtctgcaggcactagcaggcctgagtgttgtaccctctgccctccacatcacaggttatggactaaggaggtaaatcagagtgatgaggtcctggtaagagcagtgtctaaggcagatgaagtattttgtgggaaaggggactgtagagtcagtacagattataattctgctataaggtatcctctctacatcaactcaatccatttgtagtagctgaagctgggacatgaattttacccttccttctagatacatcactagctaaggtattaataacaaattctctagggaatgtaagcaccatgatcaaaaggaaaaaacagaactaatactagaataaaatgtagtctaatggagaacagattcagactttaaaattcaaaagaaatccctgaaaagacgaagattttctgaaacataagacaggaacaagcatataaataagaaccaattggtgatactggataattggacataaaaagataattgtctaaataaaattcccaatggagtggtttcaatagcaaagaagcaaagagacacagctgaagaatataaactagtaagcagcaagacagtgttataaaaccctttccagaagggaagaggatggattgctgagatttctcatattgggagatgatgcaactaacaatttactttgaaaattctagagacgcaagaaatagtaaaaactaatttaaaagttctgcaagtttgcttaatagaagatcaacatataactattctacaccagcaattatcgactgaaaatataatcaaaatagtgtgataccggcacacatggagacagatgaatagaacagaatagaaaaccaatagactccaatatgcaggaaacttttgtatatgaaataaataatatttaaatgagaggaaaaaagacagagtattaaataattgggacaatttgatagatttctcaaataaatttagatcattgcctatcatcctatcccaaaataagttccacaaaattatcagaggaaaacacagaattaaaaacaatctcagagataaaaaaatgggtttctattcatgacactagatttaaaaatgttattaattaaagtaaaaatttctgcaagattaaaagcaaaataaatacaaatgacaaatggggattaaacttttacaaattatatcatagcaaatggttgatcaatcaaagatattagattatacatattgatagataaaacacaactaacccaatagaaatgagcaaaggatttgattagtagccattaaaaggaatgaatatggattttaaacatatgaaaagataatcatattcataaaaaagtaaattaaatctacaccaagtaatcataattcacctatcaaaaacaaaaataaaaatgttggactacacaatattagcaagaatatggagaactaggcatgtttatatctatgagactataaatgacatagttttcatgtgatagtgtaatgacatcatatttatgaaagacaatttggttatatgtaacaatgacaaacacacatcctctttaactcagcaattctatttaaaaaatgtatcctacaagtatgagtaaactgatgttggcaaaaagttattccctacagcactgtatataataaaacacaaattcaaacaatttaaagtatctataaataggcatctaagtaattttattatgaaaaagtacagaaaagaagatactatttacttgtaaaacataagaacaagaatgaaggaggaagggagggagtaacagagggggtgagaaaagaatggagggatggtggagggagagagagagatcttagcataatgctgtggaaagagtagtaagacttcagcaacaggacagtgtattgcatactccccaaaattttaaaaagtaaacacttttattacaagaacaccacaggtaaagttcacaggaaggtgacaatctgggagaagatatctgcatgtctagatttgacaggggctgcttcttcttcttcttcttaaaaagtaaacagaaccaaagacaaaaaccacatgattatctcaatagatgcagaaaaggcctttgacaaaattcaacaactcttcatgctaaaaactctcaataaattaggtattgatgggacgtatctcaaaataataagggctatctatgacaaacccacagccaatatcatactgaatgggcaaaaactggaagcattccctttgaaaacaggcacaagacaaggatgccctctctcaccactcctattcaacatagtgttggaagttctggccagggcaattaggaaggagaaggaaataaagtgtattcaattaggaaaagaggaagtcaaattgtccctgtttgcagatgacatgattgtatacctagaaaaccccattgtctcagcccaaaatctccttaagctgataagcaacttcggcaaagtctcaggatacaaaatcaatgtacaaacatcacaagcattcttaaacaccaacaacagacaaaaagagagccaaatgatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgtcatccccatcaagctaccaatgactttcctcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagcatggtactggtaccaaaacagagatctagatcaatggaacagaacagagccctcagaaataatgccgcatatctacaactatctgatctttgacaaacctgagaaaaacaaacaatggggaaaggattccctatttaataaatggtgctgggaaaactggctagccatatgtagaaagcggaaactggatcccttccttacaccttatacaaaaattaattcaagacggattaaagacttaaatgttagacctaaaaccataaacacccgagaagaaaacctaggcattaccattcaggacataggcatgggcaaggacttcatgtctaaaacaccaaaagcaatggcaacaaaagccaaaattgacaaatgggatctaataaaactaaagagcttctgcacagcaaaagaaactaccatcagagtgaacattcaacccacaaaatgggagaaaattttctcaacctactcatctgacaaagggctaatatccagaatctacaatgaactcaaacaaatttacaagaaaaaaacaaataaccccatcaaaaagtgggcaaaggacatgaacagacacttctcaaaagaagacatttatgcagccaaaagacacatgaaaaaatgctcaccatcactggccatcagcgaaatgcaaatcaaaaccacaatgagataccatctcacaccagttagaatggcaatcattcaaaagtcaggaaacaacaggtgctggagaggatgtggagaaataggaacacttttacactgttggtgggacggtaaactagttcaaccattgtggaagtcagtgtggcgattcctcagggatctagaactagaaataccatttgacccagccatcccattactgggtatatgcccaaaggactataaatcatgctgctataaagacacatgcacacgtatgtttattgcggcactattcacaatagcaaagacttggaaccaacccgaatgtccaacaatgatagactggattaagaaaatgtggcacatatataccatggaatactatgcagccataaaaaatgatgagctcatgttctttgtagggacatggatgaaattggaaattatcattctcagcaaactatcgcaaggacaaaagaccaaacaccgcatgttctcactcataggtgggaattgaacaataagaacacatggacacaggaatgggagcatcacactctgggtactgttgtggggtggggggagtggggagggatagcattaggagatatacctaatgctaaatgacgagttaatgggtgcagcacaccagcatggcacatgtatacatatgtaactaacctgcacattgtgcacatgtaccctaaaacttaaagtataataaaaataaaaataaaaaagtaaacatttttattacaagaacatcacaggtaaagttcacaggaaggtgataatctgggggaagatatttgcaacatccaaatttgacaggggcttcttcttcttcttcttcttcttattattttgagacggagtcttcctctgtcacccaggcaggagtgcaatggtgcaatctcagctcactgcaaactccgcctcccaggttcaagcaattctcctgccttagcctctcgaatagctgggattccaggcgtgtgccaccactcctggctaattttgtatttttagtagagatggagtttctccatgttggtcaggcttatctcaaactctcaacctcaggtgatctgcccgtctcggcctcccagagtgctgggattacaggtgtgagccactgtgcccggcccacaggggcttattactaagtacactagttctcaaccatatggtctcggtacttttttaaaccttgtacaaattatcaaaagccccaaagtacaaacacgtgcaaaagtgtgcacgcacacacacacacacacacacacacacagacacacactcacgtgccattgtgggttttatatatatatatatatatataaatatttatcatattagaaattaatactgacaaattaaaaatatattaattcacctaaaaatgacaataatgaacaggttaaatattaccattaacactacatttttatgaaaataattatattgttcaaaaacaaacaaaaatttactaagaaagagttattttatattttatcaaatctctttcaaatctagcttaagagaagacaggttctcatatttgtttctatattcaatctattgcaatatgttgttttggttgcaatataggaagaaaatgtagcttcatacaaatatgcagctagaaaagaagagatgacttagcaacttttccagataactgtagatattctttgataccataccaaaacttgaaaagtttgctttttaaattttaacaaaagtagtttgttaaattttagatgctttgtggaatctgaaatctaccaatgaagattttgtattccttgtgttaaaatccattggtctattttgcactttgaatggatttttcacccatgcatggttttgtaacattatacattggtcatttgcaacatactggctcaccgagctacgtagattttctaagcgatgacacatttcactatataatacaaaaacttgcactgattaatatcaccaccaatttcatcagaaaagtttttaattattggaatgtatgaaactcacattgatagttacaagttttccaaaattataaatttcacttgaaatttccaattttataactagcaacaaagactgtcagctgttttcattgatgtggcaggattgctgtattcattttcaagacaatatctgcctgatacccaggtatgaataactatagttggtctgtcagttgttctttgaagtaaacatgatacaaaaaagtaggggaaaggagttgtttaccttgaaactcacacaatcttgcaaaggcttttcctgtagacaatggtcacatttcagtactcagcaaaagtgctttatgcataaaccccttttcatcacacagaatactatagacttaaaaaggattgacatttaataaaataatagaattagttatcattactgcttcatcaaggatgttcttaaatgaattggatactctctttttttactcataagtgtgtaaaatagagataaatacaatgatgactagtatagtttgatgctatcgtcatgatttgtgccaaggcactagcagttttactcaccactgtttgtggcatcagtacaaacgttaacagagtaaaagtggcaaatatcgtcttagaaatattatgaaaattgtgttgatttgtgaatctcctgaatgagtctttgggatcccctgcttcttcaagggatatgtgaactgcattttcaggtgagaataactgatctaaaatatacaagggtgtatgagtccattttcatactgctatgaagaaatacctgagactgactaattataaagaaaaagaggtttaatggactcacagttccacatggctggggagggctcacatggcagaaggcgaaggaggggcaaagtcccatcttacatagtagcaggcaagagaatgtatgcagggatctgccctttataaaaccatcagatctcatgaaagttatccactatcatgagaacagcatgagaacagcatgggaaaacctgtccccatgattcaattacctcccaccgggaccctcccctgacacatggggattatgggagctacaattcaagatgagatttgggtggggatctagccaaatcatatctagccaaatcatatcaaatcatatcttctcccttctttcttcctcttcccctcctcctcctctttcttttctcttccacttcttcttttcttctttctttttcttcctcttttttttttgcaaatcacatagacacacacacaatgcaaagagatgaggaaatcaatagaaaatggagcaaatgatattaaaggtaactcagagaaaatcttcactattaaagaaatgcaattttgttaaaaaaagatacaacaatttacagccaacagaatggcaaaacaaaaatatcaaataatatcaagtattggtgaagtattctgatgctgatgatgggaatgtaaactagcatagccatttctatctgttagttgttagtaaaattaagcaaccctatttctgggtatttttccctgaaaaacttttgcataagtgctcaagaagaaatccacacacatatctattgtaataacttttatgttagcaaaggagagcagcttaggtgactatccccagaggaatcgaatattaaaatataaagtgtacctgtgtgtatgtgtgtgtgtgtgagctctcacacaataaatatactctctaagaatcagaaatgatgaactgggtttttatacggatatctaaaaaacataagaatatgtgaaaaagaaacaagataattaaatacacacagtaccatgtatgtaaatttaaaaacacaccttatgatataacatcatgtactctccaataattgacttcaaatcaacacaaagaaggtagaatgaaaggttacacatcagctactaggttgggctcacatagaggaagaggaataggaaggaaggtgggaagagaataacaatttaatattaaatggcaagataccttacccagactgatgataataatgtgccttgaaatagggaggtgaagtcttacatcagtgctggcaggtgagatctgaagtgggggaaaaatcattggtttctcctttacttctctattctcaaggaaaatgacttaagtatggccatattatgcaatagcacagttacctacaaaagtgataggaatgttgaatacagaggtcctaaatccattggaattttttgggtgatagaaacctcttttgttctaatgtggtgactcttgataggctcctgaatagccttgggatgagagtggtggccaagggaaccaatcaggtgattggagggttggaacttcagccccacccctgccccgtcctctaggaagaggagagggactgaaggttgagttcaccattactggccaatgatttcatcaatcaggcctaaataatgaaacttctataaaacctccaaagaacaggtttcagacagctttcgggttgctgaatacacagaggatcctgtagggtgtcacatcagagagggcaaggaagttcctcttctcttctcccatatctcaccctatgcttctcatctgcttgttcatctgtatcctttgtaatatcctttataataaacaagtaaatgtgtttccctgagttctgtgaggcatcctagcaaattatttgaacccagtgagggtgtagtgggaaccccaattcagatgcaattagcgtctgaagtctcgtggaactgtcttgaggaagtcttgtgggactgggcctttaacctatggcgtgtgcagtaactggggttagtgtaagagtgtgcagtaactgtagaatactcagtcagtgtccactgaataactggttgttggtggggagaatcaccgttttgtgaccagaagtaaagtgttaagtgaaagagtaggaaatttttttttttctatctcaaacaagtatgttttcaactggtcacagtgaaaacaattctcctactagggcttttgcttgggagctggcaatacaaatgtgtctcaggcaaaaagaacaggtaaccatctgttttgggtgataccagaaataacttgagcttcccagacagttctaaatagacttccaatgatttggattgcaaatatgtcacttaagggatttaaaaaaataaacagacaagcatgatcacctaaagtttccagttaaaaagcacagttaaaaaagttacagggatttgcaactcccctgttctttcacattatcttattaatataaagtattttatcaaatgcatcattaacacattctgtgaaggcttgggtggtgagaagcatcatgaacacacctaaggaggaaggctttggaggtgtttaaggataaaaagagtaactctggttcacgcctgtaatcccagcactttgggaggccgaggcgggcggatcatgaggtcaggagatcgagaacatcctggctaacacggtgaaaccccgtctctactaaaaatacaaaaaaaaaaaaaaaaaaaaaaaaaaaaaaaatagcccggcgtggtggcgggcgcctgtagtcccagctactcggtgggctgaggcaggagaatggcgtgaacctgggaggcggagcttgaagtgagccgagatcgcgctgccactacactccagcctgggtgacagagcgagactctgtctcaaaaaaaaaaaaaaaaaattaactcaaatataactagtcctagtggctacagtagagtctctcttaaaccacctccaaatcagcaacaacctgagcactgacactcttcactgccgctgtgaaacataattgctgctctacacatctggcactttgggctgttctctgctaagccaactctcttctgttcttgcagattaattgcacgctcatcaagggtcatttgtgtttgttccccaatctgttttcttttcaagttgtgattgttattctacttatgtaatctaattaaacacaattgataaaatgtgactggaaaagaaaaggtttttttctataaaaacatgaaaaagctttctgaaaaacctcaaaaaggcatagtactaaagagtctataatattgggataattaattgatatctaggattctatacttgaataacttcaccaatatgtttaaacaatgaaataaaaagaagtatcaattataaatttcttgacgtagtttatctaagaaacatagtatggaatttaaatgcttttttattttaatcaaggtttttagtaactaaccaaacactagttctgatgctccagataaaaggacctttaaactatcctccatgttctgaatgctggttagcctttgacatgtgttcaattaacttaattgtcctctttgaataaccatgggaaaagaacacatatgcataaacataaaactataatctctttatgattctctgcacctggtaaaacttccaattaaagtgaaacaccccattcattacacagcatgtaacaggagcaatacaccaccaggggtgaaagctgttggcatttccaggagtcggggccaggtataaccatttcatctgaatttccacctgtttctgaagggcttccactatattgtactcatctctcctctcttggtaccagctgttagagtttcttcacatcctccatcacccacagctacacattcaggagtgaactgaactggggctacatggttttgaaaactacagcttgtatatcaagtttgatgaaattgtaaatattaaggtagtctcgaactcttgtaaataaagataaagttgaagaagaaacaagaggaataaaaagagcaaacgatgtcagcacatgagtagaaatgctaatcccaataaaaaccacattagaaacaatgaaattaaggtcactttgctaatgaatatttttgaaagaagccagagtgttaccaaaaagaaaaaaaaaagtctttaatgcacaatctcaggggcagtaagtgtgctatgaaggggagagggaagaggaatgctgtgtgcgaggcttgactttcttacatttctataggtggctcatgccaataagcattggctctttagttgttgtgaaatgggctgtacaaaagcaaacagcaaaataatcaccacaaacctgttcaaccaaaagaaaaaaaaacagaaaaataattgctgttgaaacattttaaggagtttattagttaaaaactttttaacagagagatggggaggtgcattacttctaagagctgacccaggcatgatggacaagaatctcaccacagggtccatatgaatgctctccttggcatttgccatcacactgagtggatttcaaactgagtacagtgctgagtgaataagaaagaaaaataaaaatggaatatccaattactttaagtatgtcctaaccgaaaacagaattctctgataatcatatctccatccagcatggcaaaaggttagcaggcagatgagaatggattgccagttatggcccctgatttttcttaatccagtatattatttgcagcatgcaaataacaacaatgccaacagaacagtttccaagttttgctatgataatactctacacctttccatgtgtggaaatattattggtagtggtagcaagtgtcctggtattttaaattctgacttgggatcaattaaacatcaagacaaaaacaaatatcacaaataaaaagttaaaaggtacttctgggaaacagaaaactgtgatgttctttatttttatgcactgatgataaaagaagtctacaaagcaaacatacactctagtgtaaagggcgacatgttttctagcatattaatttctagcatggtagaatgtgaatgaattaaccaaaaaaagaaatgagagagctaaacagaaggagtggctgcctttggaacacatacacaatagatattatcaagggacaacttagcattctacattctttgtgtttttctggcattactgtaatccaaatatatacaatcttaaatttgcatttcaaaaataaaataaaataaatacattttaggaattaaatctcattgtcacattgaaatacattaacatatgttctgagaaataacaaaagggcttttatattatggtttttcttgagaatttaagtttatgattcaaaaaatgtgtatcaataaactaaatattccttagttgtttctcttattgagttgttactatagacctaaaggtagctgctaggaatgttttatgctgaattaaccagattattgaatattagacatattaggagtaagtttttaatatgttgtccaaaatcagacctacactgtcaatattccgtaatctcttaacacgtcccctgatacaaaagattcattgcagtctgtaatgacgtttacctggaagaggtcatatcttttaatccttccagctgcttatacatttctatagcagggatgaatttttaatttgcattgtattttcatgggcatgtgggtactacgtttaaatatttaattattttaaaaataaaataggaaagataaaatagcttaaagtgtattgatgctctgaataactttatgagtgaatagatactgaaatttgaagtcagtgttttgcacaacaaatcaagatttgggactggacttactgggttggggacttcttagggataacggtggtgctatgagcatgctggaaagatgagaagcaaaagcctggaattgggagtcctgtactgtctttagggtatgcaaagaggctccttctttctaggtgttcatcagtacaatatgaccactgaagggcaaaatttcctgtcttgaccccaggatgttaaaagaaagaacaataaaagttttgtttcttctaagcaaagttttgtgatctaacagttgatgactctagccaagagcaagatgtttgtcttctgaaaaccaggcttgtaacccacccatgctagggtactagctaacataaccttgggcatttttttttttaactttttaagccaaaattttttcatctatacaatggtagtaaaatgctatccaactcacagggttatctgagtcttaaagttgtccgttaggtaccctgcatctttaagcctttggttgtttgttatcattaccattcttctcagaaaagagggaaattaagtttatcatttacaaatatagaagaaagatgagtaacaaagaactaaatgatttttcaattcacactgatcaagtccttttgactttttaaaattaacttcattcgaaatacttttatatacatgatagagtatttcatttgttctttatattaaccctaaaaaataaattggatgattctggtcttcagtatggtacaagtaggggaagaagatgtggaattgtggtcatctctgcttccttggaagtaaagagcagaatacacagagaaaaaccaaactcacaacttcttaataaggtaggaatatactttatatgttttcaaaaaataaagtttcaaacactcctatatagcaagaaataaattatttgaaatttaggagggaaaatatagagtatatctcatcagttaaaaatagtaattttgccaaacagatgttggcagttaggaaatcttttaaaaactcacatattctatgttttataaagttttatttctacttcctctaaatagcataatataatctgatctaacgttttctaacgttgaagaataaattattataaattgagagaacatcattcttttattttttgatttcattactctgacctaaatttagaaaacaaattatttttaatgatcaaaagctacctcattctcatcactgactagattcattcataaaagaattgcatctgtaacacaagttttacagttaattttatgaagagtgaatagaacaatatatatgtttctggcattcacaaattccctcaaggtcattacaacttatttttccagctgtatctctgattattattacacgtgcattttgcttttaaataacaactaaaagtatttaattcatcaattttttttgcctgtctacagagtccaaacactatgctagatgcatggaaatctataaagacaggagagatctttgcacttgtcacatgtattctagaaaagaaaagacgcataaacaacaaattgaaacacaagaacattataaatgatagaggaacaaatgctttgccaaagtgaaaaatgtatgtgttttattttggtaagaggtggaaaccactgaagttttgaaaacagacaataatctaagaatggagaaaatctacagttcaattttttaaaaaatctacagttcaattaaaaaaattcaccttgcattgtaatttaccttgaattattttgaatgtcctaataacataatcagggtattttgttagcagaaattttacataattttaaaaatcatatgagtcttaggatttgggatttataatttgtaactgtaaatgtgtgaaacatacaaacatgtgggttagaacatgctcctttagctaagaggagtttgttattacctaccttctgaagccttcttctgtcaattcgtcaatctcattctctgtccagttttgcacccttgctggagagttgttgtgatcatttagaggagaagaggcattctggcttttgaaattttcagcatttttgcgctgatttttccttatcttcatggagttatctacctttgatctttgaggctgatgacctttggctggagtttttgtgtgggggtcttttttgttgatgttgttgttgttgttttctgtttgttagtttctcttctgccaagcccttcttctgcaggtcagctgcagtttgctggaggtccactcccagaccctgttcacctgggtatcatcactggaggctgcagaacagcaaagactgctgcctgcttcttcctctggaagctttgtcccagaggggcaccaacctgacgccagccagagctctcctgtatgatgtgtctgtcgacccctgttgggaggtctctcccagtcagaaggcacgggggtcaggacccacttgaggaggcagtctgtcccttagcagagttggtgcgctgtgctgggagaatcccccttgtcaggatcagctgctctcttcagagccagcaggcaggaaagattaagtccactgaagctgtgcctgcagctgcccctccctccatgtgctctgtcccagggagatgaaggttttatctgtaagtccctgactggggctgctgcatttccttcagagatgccctgcccagtgaggaggaatctagaaaaacagtctggccacagctgctttgccgcgcctctttggcactgtcacgggaaaaccacctactaaagcctcagtaatggcggatactcatcccttcaccaagctcatcaacccaggtggacttcattcaggctgctgtgctggcagtgagaatttcaagccagtggttctcagcttgttgggctccatgggagtgggacctgctgagtgagaccacttggctctctggcttcagccccctttccagaggagtggccggttcttctgtctcactgggattcaggcaccgctagggtacaaaaaaggacctcctgcagctagctcagtgtctgcccaaacagccgctcagttgtgtgcttgacacccagggctctggtggtgtaggctcatgagggaatctcctgatctgcggattgcaaaaatccgtgggaaaagcgtagtacccaggatgggtagcacagtccttcacggcttcccttgttttgggggagggcaggtcccccggctccttgcgctttctgggagaagcgacgtcccaccctgcttctgctcgctctctgtgggttgcacccactgcctaaccaatccagtgagatgaactgggtaccttagttggaaatgcagaaatcaactaccttctgtgttggtctcgctgggagctgcagaccagagctgtttctattcggccatcttggcccctccaaaaagggcttccttttttacacttaagaaattgttaagggactagcactatcatattctgccttgaatctagtcgtgaacatggtattttgctgactcatattaggtatgagacagttcagttgtgagtgacagaaaacccaaactaactatgtcttaaatagaaagaggcttcttatttgggtaaatgtgtgactacgcagaaggtgctgataaatcagggccccaggtatcctctgtctcgttacccagtgtatatacctgatcccacggtccaagatggcagcctctgagttcctggaaggatggaggcagggatgaagaggggagaagaggatgtgtggatactctctgttaaaaaaaaattcctaggaaccaccatgtgacacttttgcttatatgcctttgaccatttgagagtctcatcaacaatagttggccacatctattgttgggaatgagaggttgggaaatatatttagctaataatctctttaatatgaaaacagatggaaaggatgttgggtaacagttaaaagtcctgactataactcttaataaatatttgttgaattattgagaacatgcatttattaatcactggctttatggccaatacatgactaaacatcctttgtataatcttcacaacaattttaagaggccatctatttttgttgactctttgtatataaagaagacatacctttgagtggcccagtaactttgttcaaggtgacagtcaatggccagtagaacccaggatcactgatcttgaacatcctcttccttcaccatataatataactgcttatgtaaatgtgcttcacttgcattacatttaaacatccagagaacaggtaatgtggtttatcctcactttatttattaatgcattcaaatatatttactgagcaaataaaaaatattctcagtcttggggatatgaaaacattatgatagcatatctgtttcatttttttatgaaaggttagtcactagtcaccagtcactgagattgacgagaatacaaagagagccaacaaatagtattcctgccctcatgcagcttacctaataaacaatatcttacatagtctaattactagctgcggcaagggctgtgctagaaaagaacaagaagctgtgaaaatatatattagaatggaatctagttgaggagagggatagggttagggaaagcttccctgaggaactggcatctatacagcaattggcacatgggaaataataaatatattgaatgaatgaataaattcattaatttaaatgaagttgggggtctcttgggaatatgttttttctaagcatggaaaaaaagaatgaagtacccttcaagaagtcccatgtggctggaactcacagagtaaattcctcacatttcccagaacataattgcttgttgaatgaaatcaaatagctttttctctctgaaatgtccacagaatgaagtagaaaacttccatataagataatttgaaatgttttctccactccaataagcccacatgggcagagaaaacttatatattgtccaaatagctctctacaaatagtagctgctcaacaaatattcattcatctactgtagatttgagactcagaaaaacattccaaaaagtatcagataatgcattgatgtttcaaaatttatgtacatctttccaaatccaggctaatgcatgctcttaaaaaaaagaagctaagatacattggcaattctatttaaatgtctgggttttttgtttgttgtttgttttgttttgttctgtgagaatcacattttggtttaagagcttctggaaagctgacattatgtaaaaatactggcttaggctgggcccctgcaaagaaaagtaagataaaaatattcacatatacttctaaaattcagtacttcatctcttaacaacactaatgatagtaataaactaaggagacctgcattgaacatagtttttctttttttaatctgagaaatgaaaatacagcccatgtattatgaattcagagaaataaatgtttcaaagtgattgaagcattaagtatataatagaagcaagaaaatgtgacaggctatttgtggggggaaaaaggagagcttgattattttcttcaagagccaaaatcataacaaaataaagtgatctataccaagtacactagcattaggatgaaatagctaccactttaattaaatatatcagttttgggaaaacagcagcagtggtagcaaaaacatcaaaagcaaatacatggagaaaatgtaaccaacatatgatataaaaaagaaatgttctgaaaaaggcattaaaggagaataaatacactcatttagaacctcaaagttcagtgtatctcttctctagagtcctgcaaaatgatactttcaggtgagctatagtctcagaaactgttttgatgaaaatggaaataggagaagatgaaacttcatttagaagttcccaaatgttccctaactatctctttcaactctaagtggatgtcactcaacctcccactccactagatggggccatgggactcataaatggccaacggcttagaagcagaagtgtcacatggcagtggtgtccatttaatccacttccactctctatccagagcaacaagtaattttccaactcaatgctatacacccttatcaggatttttctccaagttaatcaaaaagccgatgaactccttttcttgaatttgatagatatcttagtagttaatgatgcatcctcaagctctcttagtatttcatcttttatttttatttcaacagctgccagtctagtttaggccctccttatatctgcctccaggcagttagctgtaaaagcctcctagctggtatccttgctcataggttcccctctctctaaagcacaattcaacaattattccattaaattttactgaaagcttcatcagcactaggcattgtgttaggtattcagaacacggaccacttacatgtcatcttcctaaactctagttctgacagtatcaatacccttccataatcaagtgccaccttagtctaaatgtgatgtattttcacattttggcatctccttaccttttcaatcttttatcctcctattacccctacagatatgcaactcttcactataataagactttactctgatgtccgttgagctttctccatccccagtgcgactttgtttattctattctctctgtctggaataacttccttaatgtcatcctcaaagatgctaaatatgctaaaccatctttaataattaaaatgtaaatggattttcgatgttttcattatattccagttgcacagaaaacaagtatttcttaagaactcctaggacccagttaaaaatttaacagtaaaacatttaaagcctggtcttatgaggttgtgaatattttcacaacccttttactatttagtcataacttaattattgaaggcctcatgttgtaggcaaaaatccaatcccttggaaacaattaagcattattaccatttttagttcatggaggaatgtggattccacctaaggatgtcactagtagaggcaggttaataataaaataccatcaaggcagcatagattgttatgttttggatttgtaatgtcttgatgccatccattgctttaaaatgtttcacactgatgtctcattttgaagagcaatatgcttttctccagcattttgacttatttaatgaagttgtttctaataataaaaggacacatcttaggtgaagtatgtctcttttgctagactatgagttccatcacggtagtgatttctacattttctcgggataaccaatatcaaaattcgctgggggtatctgcccgttatgtgttcccctgggttccaaatctcacctcctaaataagaaactttaaggttgggaaccatatttaaaaagctcttcagataatttttatgtggttaaaatttgagaaccattgccccaggctagagatgaatgaactgcttgtttatggaaaattcaaattttggccaggcatggtggctcatgcctgttatcccagcactttgggaggtcgaggtgggtggatcacgagctcaagagaccgagaccatcctggccaacatggtgaaaccttatctctactgaaaatacaaaaaaaatagctgggcgtggtggtgcgtgcctgtagtcccagctacttgggaagctgaggcaggagaatcgcttgaacccgggaggcggaggttgcagtgagctgagattgcaccactgcactccaggttggcgacagagccagactctgtctcaaaaaaacaaaaaaaaaaagaaaaaagaaaattaaaattttatgggatataacagttacttaatatagccttaagaaaatccaagactgccccacagtcactaacagtgtccactgctccccctcaaaataaaagggaactaccaagagttgtcaaagagaggatagtgaagaggttacaaatgctttagggctgcccctcacactagctgcctgggtttgactcccaacttttcaacttactaagtttagtaaacatagacaatttatttagctttctgtgcctagatttctccacctgaataatggggataagaacaatactggttagacggaattacagtcaatacatgcagagcagttgaaactgcagcacatagtgctgaagtgctaactgttagatcttaaagctaatacataacactacggacaatgaaactaatttctaacctaaatatggaaaatatataactttttctacaattaagtctaactacattcaattagttttaagcaacaacaacaaactcccttaaatagaaatggttttaaattaatagcctcttcaaaaaagtaaacctttcagaatcagaccacgtggcttagtactgtcacattttcaacacaaggaggttttcagtgaggcactggggcagaacaaatttgcacagtgtctgctgtggacataagggatttcttcagccctatgcaaatagtaatcccactagttcccagaagataaacatgaagagacaacgaaacctttagctcagatgctcacttacttctgcttctctgaatttctcacctttggggacttgagaacaggctgccagtaaactttctatgctcttgcaagaagccctgatgcagttctattagaactaattgttacattagaggcaatatgagaatctaattcataaatagcatttcccataggcaggtctcataagcaattttaataccttttgttgagatagtttcagattcgcaagggaatactggagagtgcatttaccaacataggagaagagttacaataagaaactctcaaaaatgataggaactcaaaaatgataggaactcagcgtgctaactcctttagtcctaagtgccagaaatagggatacagagtccaggggcaatttaactggtcatgtgaagagatatcaagacggaaccagagtgaatttgccatgaatgtgactgaggtagattgtaaaaccagaggttctcaattttgaattttttttatgataaaagcaagttgttaccttcaatcaattcagattttctccatttcactgtaccatatcataaactaaataaaaagaaggtattttggtaatattcatgaaacaaatggaaaccaactgaacaagaaggcatttaaaatctcaaactttgtaaatataatagcgaaattagaaaagttttcctcatggtcaaaatgtatagcaagtatatttaaaaagtcttttatataataagcttggttaaactgaattgtctactgagagtctgctaaactcatgctagtagatgctaaaaactgtgttaaagtaattctctataactctttgtgttctgtattttatgagaaacagtaataaaaatagtttgtatatctgacatttttacaagggtaaatattacaaatttcataagctataaatatactagtattttagagcttcttttctaaaataagttaatcttggagaagataattttacattaacaatattacatctaaagtttctaaactcatggtgtgattataataatacatttataaaaatgtgcaagaagctaaatcaaacatttattcttttaacatttgaggaaaaaaaaaacaaaaacaaacaaacaaaaaacagaagtgggataggagaaggcagaagttttacaaggtttaactggtagacttcctggcaaacatcctacaaatactgcccaagcccatctagccttgcctataaaagtggtttgcagtgattatggagtaaagtatgggtcactaggatttacaggaagtatggttcctctgctctctggattggtgaggcactccccgtataaatataaatgcaccacatgtggtaccaatggatcatgcttagccaattaaaatgtgaatctataacagccgaacatagtaaactgagtcgccagggcattcttagtatcacacagtgcagaataattgccatgtgaaaacaaatactatctttctccttttttttttttgttcagtattccctattcttctattagtcaattactgacatctatttaacatagttttatttaaaggtgccatgggaatagacttaaactaactctgattcctactctcaagttgtttatggtataggaggagaaggaaaagcaaacaatgactataaaggtattttagttactatgattttgatatatagttgaccgagtgggataaaaggattgtagtcacttctacctttgaagataaaaggcagggctttcagggattacttcacagagaagggaatgatggggctgaatctaaagaagactggaagctggtcaatagatgaaccatgcagtgcatgtattgaagcgcagaggcagaataagctggattaatttgaagaacagcaagaaattcagtttagtgaggcactgggtactcaaagtgggagaggaagcagaagagatttcagatgcagcctttttttttttttttttttcagacggggtctcgctctgtggcccaggctggagtgcagtggcacagtctcagctcactgcaacttctgtaccccagattcaagtgattctcctgcctcagcctcccaagtagctgggactagaggtgtctgccaccacaaccggctaatttctgtatttttagtagagacggggtttcaccatattggccaggctggacttgagctcccaacatcatgatccacctgcctcagcctcccaaattgctgggattacaggtttgggccaccatgcccagtcccagatgcagctttttaaaaatacagagcaactgctatatggttcatcatgtattccaaagaatctagagttaagatctaaaacacagctttttagagaaaaaaggcaagcaatacaatatgcactaccactactataactgtggtaaatgaccaaataatttcagacaaaacatacttttcaggacagaagcattaagacatctttacttaatgcatagtgcttttttaatttaaaaagaaacatctgtttaaaaacacacaactatgtatgaaaaactcatttctaataaacaattcaaatagaaatcataattttccacctgggatcatagtttaaaaaatatcattagaaaaagaaatatattaatgtccagatataattagctttaaagaggtgtatggtaagaatgggaatatagtttagtatatattggcatgtagtatttttcttcaacagaaaaggctaaaatattttccacttgaataaggcagtattaaaaacgaattagattgtatgtaattcagcttctgtaactagaaaaaaggctgaaaatgaaaaaaaaaatctacttcttaaatcctggtcttttgaaaatgatttttgtatctgaaaaagctccaggtgtctataaatatcaaaaacgtttttatacacattacatacagacatatgaaatgaaatagatgattagttctttttttgtagcattctcaatcccactgttaacaaagttgttaaaaaaatccatgtgtgaaatttgtactacagaaatttataacaatttatgctcacttaattcccttttgggccgatatattctacattaactataattttcttaaaaatgcagaaggtatatggttttgcatttaaatatattaagttttataacaaagaaaaatcaaatagccatttagaaacattaactgtttcatgactgatggataatgcttacttgtgagttgctgccaaggctgtctgcctgaagttcagagaattttcatgggttacttatttcccattatctttcctcattttcttcactgttctttcctctccctccagcctaggtggtcatcactacttgcagttccaacaacaaggttcccacatcatcaagcaaaagtgttttttattttatttatttatatttttactgtaactcagggcagtacaaacctaagatttataaggagacgagacatatttttactgtgaagtctgagcatgacctgcactaggcctgtggagcaatttagaagtttctatttttaccaagtgtaaattggtaccagtagagtggggcactgctgaaaaaatacctgaaaatgtggaagcaactttggaatggggtaacaggcagaggttggaacagtttggagggctcagaaaaagacagaaaaacataggtaagtttggaactccctagagaatggttgaatggctttgaccaaaatgctgataatgacatggacaatgaaatccaggctgaggtggtctcagatggagatgaggaacttgctgggaactggagcaaaggtgactcttgttatgctttattaaagtgagtggcagcattttgctcctgctctagaaatttgtggaactttgaacttgagagagatgatttagggtatctggcagaagaaatttctaagcagcaaagcattcaagagctgtattgggtgctgttaaaggcattcagctttataagggaagcaaagcataaaagtttggaaaatttgcagcctgacaatgcaatagaaaagaaaaatcccattttctgaggagaaattcaagccagctgcagaaatttgcataagtaatgaggagctgaatgttaatccccaagacaatgggggaattgtctccacagcatgttagaggtcttcatggcagcccctcccatcataggcctgaaggcctaggaggaaacagtggttttgtgggctgggcccagggtccccggtgctgtgtgcagcctagggacttggtaataaatcgttacaaatttctgtagtacaaatttcacatacggatttttttatgaagtcaataattggggtttgggaaacactgcctagatttcagaagatgtatggaaatgcctggatgcccaggcagaagtttgctgcaggggtgaggccctcatggaaaacctctgctagggcagtgcagaagggaaacggggggtaagagcccccacacagagtccccactggggcaccacctagtggagctgtgagaagagggccaccatcctagagaccccaaaatggtagatcccccaacagcttgcaccgtgtgtctggaaaagccacagatgctcaaaggcaacctgtgaaagcagccaggagggaggctgtaccctgcaaagccacagaggagaagatgcccaagaccatgggaacccacctcttgcatcagcttgacatggatgtgagacatgcagtcaaaggagaccattttggagctttaagatttgactaccccaatggattttggacttgcctggggccagtagcccctttgttttggccgatttctcccatttggaatggccgtatttaactaatgcctgtatcaccactgtatctaggaagtaactaagttgcttttgattttataggctcataggctgaagggacttggtttttttcagatgagactttggactgcagacttttgagttaatgctgaaatgagttaagactctgggggactgttgggaaggcatgattggttttgaaatgtgaagacatgagattttggacagtacacaggcagaatgacaaggtctggctctgtgcccccatccaaatctcatcttgtagttcccataatttccacatgtgtgggagggacccagtgaaagataagtgaatcatgggagcgggtctttcccatgctattctcatgatagtgaataagttacaagatctgatagttttaaaaacgggagtttccctgcacaagctctctctctttttgcctgccaccatccacgtaaatgtcacttgctcctccttgccttccaccattattgtgaggcctccccagccatgtggaactgtaagtccattaaacctctttcttttgtaaattgcccagcctcgggtatgtctttatcagcagcataaaaacagactaatacaccaagtgacccatggtttcaatgcacattgaagtttgagaaataactgtttttcctctcacaaattctatggcacataaaaagggaacatattaagatcatagccacatttctaaaaaggtaagagagttccaaacccaattttctcagtgataaaatactagaactgaaaaaacaactggtgaattaactttcgaaagaaaaattgtgacattgccctagtattatactatatcatacacatcaaatatatcagcacacaacggtaatacatagtataatggaaatttctttccttgtattatgtaaatattatgttaatgtagtttttactttaataaaagtcctaataaaaataggctgtttggatataatataattcaaatggagtagttagcaaaccatgtaaggccaggccacatatgttttgtgttatgtttacccagcttacttttatcttttctggattcagagcatcctgaaagtaggtgttatcttttctctactgcctagtagtggatagagtgtagagtacacattcatgagtaaatgtttgtggaatacatgaataaattaatagctggaaattcaatgtatatgtattctagaaaaacacacataaacacatatatataaataaaaatcaacccataaatttaaaaaataaaattaatattttactacaaatagctataaaagaaaagaaaaacacagagaaattgacactgcatatcttgaaaataaataagaaatagttatactggctgaccctcagttagttagcaaagcacccagaatttaaaatacacttgttataatccaagacatatttctataattgtgcaaagttgctaattctaacatgttaatcagaaagaaaaactgatattctaggatgctgatgagctaatgtttaatgtagtggttaattattagttggaaaaaatctacataaagaaataaagctccaaaaaactagaaatctgaaaaaaaaaaaaaacttgtttaactgcatttaccaactctttaaatccagaaccagttatgagcattgtggtactattaataattgcatgctgaacatataaatgtaaaatggcaatttcaattttcgtttcatcaagacaatgaagaaaatgaaattgaatactaattagtgcatgtttgtcatacacctgaaagattagggggttactgtgctcattataagtgagtttaagcgaagtactcaaaggtttcatttgaaggactgaatataaataatagacttaggtgacaagggaaattaacaatgaatgatcaacacagaaactctggtatatcatttgatttcacagaatgtcttataggtgatttaatcttacaaaattgataaagttttttcttctaaaaaataacttagaaaatatgttattaaagaatgcattaacaaaatatatatatttgaacataatcagtaagtaattactgaataacaatgttgagactaagaaaattactcaaaaccatatgatcacatggaaattaaataacctactcctgaatgacttttgggtaaataagtaaggcagaaatcaagaagttatttgaaactaatgagaacaaaactacaacacttcagaatctcttggacacagctaatgcagtgttaagagggaaatttatagcactaaatgcccacatcaaaaagttagaaagatctccatttaataatctaacatcacaactaaaagaactagggaaccaagagcaaaccattcccaaagctatcagaagacaaaaagtaacaaactcagagctgaactgaagtctgagacatgaaaagccattcaaaagatcaacaattgtgaatgggagttcactcatgatttggctctctgtttgtctattattggtgtataggaaatacctagggatataacttacaagggatgtgaaggaccctttcaagaagaactacaaaccactcctcaaggaaataacagaggacacaaacaaatggaaaaacattccatgcacatggataggaagaatcaatattgtaaaaatggccatactgtccaaagtaattcatagattcaatgctatccccatcaagctaccactgactttcttcacagaattagaataaacaactttaaatttcatacagaaccaaaaaaagcctgtatagtcaagacaatcctaagcagaaagaacaaaactggaggcatcactctacctgacttcaaactatactacaaggctacagtaaccaaaacagatatatagaccaatggaacagaacagaggcctcagaaataatgccacacatctacaaccatctgatctttgacaaacctgaccaaaacaagcaatggggaaaggattccctatttaataaatggtgttgggaaaacgggctagccatatgcagaaaactgaaactggaccccttccttacaccttataaaaaaattaactcaagatggattaaagacttaaacataagaccttaaaaccataaaaatcctagaagaaaacctaggcaataccattcaggacataggcatgggcaaagacttcatgactaaaacaacaaaaagcaatgacaacaaaagccaaaattgacaaatgggatctaattaaactaaagagcttctgcacagcaaaagaaactattatcagagtgaacaggaaacctacagaatgggagaacatttttgcaatctatccatctcacaaagggctaatatccagaatctacaaagaacttaaacaaatttacaagaaaaaaaaacccatcaaaaagtggtcaaagggatatgaacagacacttctcagaagaagacatttgtgcagccaaaaatcatatgaaaaaaaaagctcatcatcactagtcattagaaaagtagaaatcgaaaccacaatgataccatctcacaccagttagaatggcgatcattaaaaagtcaggaaacaacagatgctggagtggatgtggagaaataggaacaattttatgctgttggtgggagtgtaaattagttcaaccattgtggaagacagtgtggtgattccttaaggatctagaaccagaaataccatttgacccagcaatcccattactggatatatacccaaaagattagaaatcatgctgctataaagacacatgcacatgtgtgtttattgcagcattattcacaatagcaaagatttggaaccaacccaaatgcccatcaatgatagactggataaagaatgaggcacgtatacaccatggaatactatgcagccacaaagaaggatgagttcacatccttggcagggacatggatgaagctggaaaccatcactcttagcaaactaacacaggaaaagaaaaccaaacaccacatgttctcagtcataagtgggagctgaacaatgagaccacatggaaacagacaggggaacatcacacactggggactgttgagtggggcagctaggggagggatcgcattaggagaaatacctaatgcagatgatggattgatgggtgtagcaaaccaccatggcatgtgtatacatatgtaataaacctgcatgttttgcacatgtatcccagaacttaaagtataataaattaaaaaacatctgataatatttcttagcgatacctatatttctttgagaaattgtgtttgtttttcaataaatacaccaattttgatttcagtctgaaaaattcagctcaatttactctgatagtttggaaatagtcctgttatgctattccatttaaattgttaaatatattattactattagaaaattatagaacatgagaacttaaggccctttttctttcgccaaaaaaaattagtggaaaccaagtcatctcacttttagcttgaattgaaaacaaacctacaacaccaatagttttatttttaatttgtgtaatccttttagaattattaatattcaatctgagttcagtacattgctgattggacaacactacatatcctccaatggtaatttaatgacagttactagtccgacctgtgttgcaataaacatactatatttttgtatttgagagcttaaaaatactggtcataaagaaattgtaagagctgtgaattaggctaattatatattttttgtaatctttaaagttctgacaacttggataagataattaacctgtttgattcaagctgtctaaatttataaagtgatgataattacacctactatatggaattattctgagaattaaatttaaaaatcacccaaagaagattaaaaaattcaagaggttgttactgaaaaaactaataaaatagatagactgctagctagattaataaaggagaaaagggagaagatccaaataaacacaattagaaatgacaaaagagatactactaataaccatcagcaactgctgtgaacacctctgtgcacacaaactggaaagtctagaagaaatggataaatccctggaaatatacgccctcccaaaactgagtcaggatgaaattcaaatgagtagacaaataagaatctctgaaattgaatcagtaatagatagcctaccaaccaaaaagagcccaggcccacatggattcacagctgaattctaccagatatacaaagaagagctggtagcatttctactaacactactccaaacaatcgaggaagagggactccttcctaactcattctacaaggctaacatcatcctgataccaaaaccaggcagagacaaaacaaaaacagaaaacttcaggacaatattttgatgaatatcaattcaaaaatcctcaacaaaatacaagcaaattgaatccaatagcacaactaaaagcttatccaccatgatcaagcaggctttatccccaggatgcaaggtaggttcaacatatgtaaatcaataagagtgaataatcacataaacataactaaagacaaaaaccacatgatcatctcaatagattcagaaaagccttccaataaaatttaacacctctcatattaaaaactctcaataaacttggtactgaaagaacatacctcaaaattatgaatcacctatgataaacccacagccaacatcatactaaatgagcaaaagatggaagcattcctcttgaaaacagaaatgagacaaggatgccctttctcatcactcctattcaacatagtattggaagtcctggccagggcaatcaggcaagagaaaaaagtaaaagccatccaaaacgggcagagaggaagccaaagtatccctgtttgcagaggacatgattccatatctagaaaaccccacagtctaggcccgaaggatctaggaaaccccacagtctaggcccgaatgatccttaagctgataaacaccttcagcaaagtctcaaggtaaaaaatcaacatacaaaaattactggcattcctatatagcaaccacagtcaagccaagtgccaaatcagaaatgccatcccacctacaattgctaaaacaaaacaaaacaaaacaaaaaaaaaacgaaaaaaccctcctaggaatacagcttatcagggaaataaacaatctctacaatgggaactagaaaacactggtccaagaaatcagagataacacaaacaaatggaaaaaccattccatgcttgtggatacgaagaatcaaaatcattacaatggccatactgcccaaagcaatttatagatttcaatgctaatcctatcaaactcccaatgacattattcacagaattagaaaatactatcttaaaatagccaagacaatcctgaagacaacaacaaaaataaaaccccccaaaagctagaagtatcacattacctgacttcaaactatactatagggctacagtaaccaaaagtactgttttgatactgatacaaaaacagacatatattccaatggaacagaattgagagaccagaaataaggttgcacacctacaaccatctgatcctccacaaagctgacaaaaacaagctatggggaaagaactccctaatcaataaatgatgctgggatagtggttagccataggcagaagattgaaactggaccctttccttacactatatacacaaatcaactcaagatggattaaagacttaaatgtaaaatccaaagctataaaatccctgaaagacaacctaggcaataccattctggacagaggaaatggcaaatatttcatgacaaagagacggaaaacaattgcaacaaaagcaaaaaatgacaaatgggatctaattaaactaaagagcttctgcacagaaaaaggaactatcaacacagtgaacagacaacctaccgaatggaagaaaactttttcaaactatgcatctgataaaggtctaatattcagcatctataagaaacttaaattttcaagaaaaaaaacaaacaacttcattaaaaagtgggcaaaggacataaacagacaattttcaaaagaagacatacatgcagccaacaatcataggaaaaaaaccctcaaaatcagttatcattagagaaatgcaaatgaaaccacaattagataccatcttacaacagtcagaatggctattactaaaaagtaaaataataatagatgctggcaaggttgaggagaaaagggaatggttatacactgttggtgggagtgtaaattatttcaacgattgtggaaagcagtgtgaagattccgcaaagaactaaaaacagaactaacattcagcccagccacagcataactgggtatatacccaaaggaatataaattgttctatgataaaggcacatgcacgcctatgttcactgtagcaccattcacaataacaaagacatggaatcaaccgaaatgccaatcaattgtagactgggtaaagaaaatctgatacatagacaccatggaatactatgcagctgcaaaagagtcagatcatgtcttttgcaggaacatgaatgaagctggagcaaactaattatccttagcaaactaatgtgggaacaggaaaccaaatactacatgttttcccttagcaccacttacagtgggtgctaaatgatgggaacacacggacacatagaatgaaataacagatagtgggacttacctgagggtgaaggatgggaggagggaaaggactaggaaatataactaatggatactaggcttaataccagagtaacaaaataatctgtacaacaaaaaccccatgacatgaagtatacctatataacaaacctgcacatgtacccctgaacctaaaataaaagtttcaaaaaaaaaaagaaaattggtaaagttttgtaaaaaataacattaaaaatatattattaaagaacacaattataaaatgaatacattgaatataattcctaaaaatttattgaataacaataatttttagtttttcacccattatatttgaggttctcactctaatataaaacctttcatgtttactttagctgtttttctctgagttcattatcatcttcagaccaaaagcaaattatcatcatcccactgaccttaaaagtaaaataagttttaactattgttcttaagagaataaatctaaatttttctcagtgttgatcactgtcctgttcgattaaggttatttctgcctacagccactgggataaagggaattaaaacttcacacaatactttgaaaggaagaatgatgcatagtgttaagtaggcaatactgggacaaagtaaagtgaacaatcggatatgaaacattaataaggtgtttctcagagtaaacactggaaaagcatgctacttatggtttatagaaagatggcaatcattgaagctcacgaacataatttgccaaacagaaaccctgatgtaaactggtgatatcatctctcaactgttctgaattttggctatgaatattaatgtctaaagttttatcatgaccacagtcctacaaatgcatttcaactagagtgattaaaaatgtctctggaatgattattcattagtaaatatgatataattattttctattattctgtgcatattttaaaccttaatcgatccttcacaagtgtgataaaactgtatagatgtgccatttccactatctggagttcattttgcacatgttgctatagattgaaaaagtcaagtgtaacttaagaagcaattttaacaacttcatgtaaatataaattcataatacaaaacaagaacttcaggcaaccttattagagctctatagataaaagaaatgtttatgagacatataagaatgcctaagaaatctgaacaaagaaagtatctgaaggagattttggcccagtttttcaagtatggaagtcttgcctcttagccataaatcaattttcgtttataccaaatgcctgtaaactagttcttgtatagtacacctaattatgtcacatcagggatttccatgtttctttgacttagaatacgtagtaaacagatagaacagatcaatcacctaaactaatcaaaactctgcaatatctccctactctactgaaataaggctaataccttttagtatgactcccgaagcacagcaaactcgtacaatgaatttgaacacatccctccagcaacctttactctagtcatgattttctacaatattccccagattgtcatgtagcatctttaatcaggctgttccctggatgttcagtctctactgaaagccatccttctcaggcctagctcaaaagctatctgccccaggtgagtttctcaagataattaatgaattcttcctctgaccacagaatactgaattcttcctccctttagtacacatcaatgacttgttagatggttattaatgtgctttccccaacagaggtttactctttcacagacatcagttttgatcatctttctgtactcctagtacatagttcatctaaatgctcaaaaagcattgaaatgtacagaaatataagctctgggccttgctaccccctctgggaaatcacttaatatttcagtatattgttgttttctcctgttttaaaaaatagctggttgatgagagtgaataacactatgaaatgaaacaccctcagcttgaaagaaggtgcatttgaggtattgttattatgatgcatggtatattttatacttgcatttgtggacccacttcttagagatagaaaacattgatataatttttatgttcttaaagtatcataagttgctgctaaacgttatcacagtggtaatgaacacacagtatacagaaagtctcctgctttgatatgcaccttaaaacagtgatatttatacctgaatatttttaacgtttttgatctctttaactaacttcttaatggaatgtgcatgttttttacttctcagaattgggagctaatttgaactcttcactaaattaccctttcctctgaccataaggaagagtcacactgagttcccttttgtctgctttttaaaatgaccagaatcatttaaaaatgacttataacattaaccttgtcccatcccatctgttacctgaatccacggccatctgtcattttctgcagctgtccacgcatttataagccccttcttattaagacgtgcatagtagggataccatttttggagtccaaaaagagctcggtgagtagaggaagctgtgatttgctggtttgatataattccaccttcaattcccagtgggcctgagcattctggaaacaaaaacaggaaaaaatatgaatgtattagaaacaatgcatatacaacatgtgtctgttcgatttgataggatttttttaaatgatttgaatttgcaccaccatgctatttactcttcatcccctttacagatctgttatcgatctctaaattaaggaaataattcttgcttctcatgaccctctcttccttctttgctttgaaagtagtcacttaatagacacttcccttctgcattatgattctggttctgtactgatagcttctggttgttgatcacgtcaacaaaagcataatgctcttaaaaggcttatctcatattttatattcccggagattagcatgcctcacaaattataagctctcaacaaatatttttccatccattatttctttattatcataaagctgagctttttttcaaagttatttttgtactaatttagcatttctcactactataaactttataacttaaatttttatacccaccatcagttatgcttccacaacaaaagggaaatgggtaaatctgttaacatttaaaaatattattataataccccatgatatattataaattataaaatatatgtagacaaattatttttataaagagagcaggtaaactctctgacaacattatacatgacaatgtgtacaactcagtaaatcaagatattaaaatacttattagcactttagtttcaaattcacaattctacatattgggattctgcatgtatatcttcacatttgcaactgagaaacttaagaaaattttccaatgaaattttaaaatactaagattaaaacacattatgctcaaatgatatgttctcagataccaaatgtatttagtttttcaaattagaaatggagataaatccatccttaaaaaattacatatatatttgtattatatataaaattatatataaattcttaattgcgttataaaatttcagcagaaggtacatttcttttaaattcagttttgaaaattcagaataagtagggatatgatataaggaaaagatgttcttaatttcattaacatttcatatactatactgaatattttgccaatttagatttgtataatatatacgataattgtattataaaaatatactacaataatttatcagaatttatgaaaataagaaagaagttcattgctactactaaatatcagtatatgaaagtcaacttgattggtgattatgaccaagtacattttagattttaattactgtcaaaatccaacatttgtcagtaattaaatgtttacacttagattgaggttgaaaataagaaaaaatattaggagccaaattataatatttttgaaacttagtaagatatttctcactgttaaccatatttttaattgtcataaacatggtaagtagctctgatggctttcaaatttttaaatttttttataaagaagataaaaatatatggataagtaatcatcttaatcagactgtattagtaaagacaacattaatacagtaaaaattgcatctttgccattgacaaaaaattacttggtatgataaatttagataataagatctttttttaacatgtaattaggactgcttagcactttatgaaagtatactatatcactttagaatcattaaattaagaagccattcattagtagaattgaagtcttacgagctgcagatgataatctgattttcacattcccaaaaacttaacgttaaaagttcagatattaattctttggacccttattttgctttccattttaaacttcaagatctttacagacttcataaacgtactaagaaactttcatgatgacactgtgactttagtaatggcaggagcctagctttttaataatattgtcatcaaaggggtctcaagcatcttgtccttagtttgtacaatgtttggatggaaaaatgaaacaggcagggagatcttttattgcaggccatttattgtaggccagtaagtagactagcagagctagagagccagaattgattaatgagctgtatggcagacttaaaaataactctgtgccatttagttgtatacctctaaagaccttatgctgaattagatatcttcacagaatttgtaactattttaaagcagagagtagatctcaaatcacaatatcctataattctacttcattgtttaatctatcaacctccctttagtagctaacatatcaggaaactcattgactttgaactgttgtatttatcagataagccaaataccaatgagcgattttgaaaatatatatgtgcaactcactctgccataaggttccaaatctttgctatgctctttagtcctgcatattaattctttcaaaaaacataattcaagctgggcgcagtggctcatgtctgtaatcccagcactttgggagaccgaggcaggtggatcacctgaggtcaggagtttgagaccagactgaccaacatggtgaaaccctgtctctactgaaaatacaaaaattacctgggcatggcagcatgtgcctgtagtcccagctactcaggaggctgaggcaggagaatcacttgaagccaggaggcggaggttgcagtgagctgagatcacaccactgcactccagtctgggtaacagagtgagacttcatctcaaaaaacaaaacaaaacaaaaaagcaaaacaaaaaaccctccacaattcaaataatatatattgacatgatatattatagggttatatcttatacaaagtatttttgcatgagctatttcattgccatgatgtcaaatttacaagtatcaccagtcctcgattctatattgttgctttaaacaaacaaaaacaaacaaaaataccccccaaaaaccaatttccaacagttgcataccacactctgtcacttacatatagtcaaaaaaggccaccaaaggaagcatgactgtgatggggattcttgaatgaagtgtgagtctgtgagttgtcaaggtactgccttgagttagtgattctgcattttcctactttttaaaatcggggttatgatgacacttaacttatcagttgtgaagaagacaagataatgaaagctttgcttttggagctataaattgctgaaaaaataatgagcttggttctgtaaggttattttcatacttctttttagaggacctcaactgaagtaatcctggctttttagcccctttcgagtaggagctaggtatttctcactgttatatccttagatgctcatggtggcttgtacacaggaaaagcccaataaatatgcactgaacgttgttattgggggctttttttgcttctaaacagtaaagtaataagcaaatccaagccttagatttatttcactctgcgaagttgtcacaacagcagattttcttcactaatcatgtggaccacaatcaaatggatgtcatcacaataaaaagttcaaaatccaatttccttttgcctgtgctatccacttcccccatatcctattaaattcaacagttataaaaaccagtgaaggaattacaattcagaatgcaaatgaatatacacctaagattaagtgaccttaagcaattaataacaggatgcttaaaaagaaagataatatgaaaatatacattgcttttactatcaacaaatgatagaagatatatgaaatgataattgatgaagtaatcaatgtcagatgagaactctgaagtttgaaaagtgtacccacatgtgttttctcatataatctttgaaataatacttcaagaaaaaaatgttttcaggactatttcatgaattagaaaaattgtgaggatggaagttaagcttgtaaaagatgactgtgtaatttaatgtggagagttcagtaattcttcaaaatttgactcggatcttttccttctgctatattatgtgaagcatacatacttatgcatcctaggggaggcaacaggaacattaacatggaatgaacatacaagatatcactagtaacactgaggatgtaatggagttttcacaagttgggatccactgcaacagtacataatgtatggcactgatatggtatgcctctgtgtccccacctaaatctcatgttgaattgtaatccctagtcttgggggagggacctgatgggaggtgactggatcatggggacgggcttcctctttgctattctcataatggtgagttctcatgagatctggtggtttaaaagtgtgtggcacgtctctcttcacactcactcctgctgccataggaagacatgcttgcttcccctttgcccttcccccatgattgtaagtttcctgaagcctcccagccatgcttcctatacagcttgtggaatggtgagtcaattaaactattttcttcataaattacccagtctcaggtagttctttataacaatgtgtgaatgaactaatacaggcattcagtcacagaattaaatacctacagtttatagtgtgtctgtctcctaaggtgttaaaattaacctgataccatcattggcttatactctgcttatctaatacggataggcaaattctgttcttattaatttattgacctctaagtatatgctcatccacccatcactccatccgttcatttaattcagttttgaaaatacgtgtttattgaagcccttctacatatttggcacttttctaggtagtagtgacatagggataaataaggcagaaaaggtctatgctcttaaaagattcacattctagtggagagacaaataataaacaaacacttaaacaagaaaataccatgaagtggtatgtgctatgaaggaaaaaaagaagggtgaatcaagtgtgggtgtcaggtgatcagagatggcctttctgagaggttacaccaagtctcatctctgaatgggaagaaggagctggctatgtttacagtactggtttcctcaaggggcttcagtgtaatggggagacacagagaaataagaacatttttatataatatggcagatattgtgttggtgaatgcagaagattcagtgggagaagagaagagggaataataacctagcttggggctctgggaatgattcccggaaaagaataggagcttgcatagtggagagaggagacaggatagacacaggcagggaacaggctgctatgatgagggaattagaggcagttcagtatcactagatcaagatgggttggtgggggaatggttaagagatgaagtggagaagtagaaaaatgctagattattttgcagaagacggtgatgatagaatttggttctgttagtgatggggagtttttgaaggactctatggccacattttcatttaatttagatcattcccactgtgccataaagagtagatttaagacgggacaaaactatgtccaaagagtaagctactacagttgtccatgtgaaaaataatgcagatctgaaagaggggcggagaagaggaagagttcaaaaatatttaagaggtaaaagtaggcagaactagtaatgattagatgcaaggtagaggagggaaatggagtgtttgaatttcaaagggtccagagagcaaacataggtgtttcctttcattgagattggccacgtttcacaaataacatcactggaccaaattcctctcttaaaatttatcaaaaatcattcttgctgttggattgaatgtgggaggatctgcttgtcttaccttccttctcttgctatactgattttggtgggctactctcaacatctctcatatcagtcaggctgcagggacaggattgagatgtaaaaatctgcttctatgctcaaaccatgtccagtacttccctggtccacaactcatccacatgtttatgtgtgcccatctgttttctcacaagatagagaacccctttgtaggcaaagattatattcctcacagtatctagcagcaagcttcaatttcagtgaacatttaataaatgtcggtagagggaattacttctaaaaaataaatatgaaaggtaaataaacaatacaaatggcaggtaatatggtaccattttatttgtatacttcatttttaattaaaaatcatttacacttacacttacatgctctcaaaggtacacagatatagaggccttctttagaaattttttttatgatgagtaaagaagagcacttgtttactatttaaaaaaaatgtaactgatagtggtctgtctgggtctcttctctttcaaatcgctgccacacagcattaccaggtatttctgaaattccccattgttacctctagagagggcatagtggcaattcgatcaatgctgaatacaaaaatagaatacggtagtagaatatggtagtctgcatttcctggctgtaagatctgtgtttatgcatccttggtattgtgcttgcttttgtcaggtacgacaataatcctaaattaatgagtccattcaacattggctaccagagaatttcaggcaccttttatacagtcatttaaaataattacactgcctgaattgtctgagtagactggaagtgccttctgacctgacaccctgctgttcagactaatactgagcaagtgagtcacctggcaggttgagcaggagcagctgggctagctgggggccaaacttcaagtgcctccccatagcaacttttctgctttggccaagagggatgtgaataaaatagcttcaaagtggagtccttctcactctgcaaattcattctctggagtatggcaaagaatggcttctgcattttattgatcttgcagctgacaagtaagcagtgcctcaagatgtctcgcatcttgttcctgagtgtgctgattaagcctttcaaataagtgagatgcacagctgaatccgcaacaggaatgtactgctttcatttgctctatctcaatatccagacatcttcagaatgaaaggatttcaaattaaaaccatgtaagaaacaaatctcctttaaacatctccagtcctccctttctccgagcatctcatcttatacgagtgagtcctctgctgtgcttaatacagcgtgataattgtgctgaatgcaagcactggtgaatggattagtgatgacctccagtactgcagaaattaatgctgattcaaatgtaagctttcctctgtgccacttggacaacagcctttcttttattcctagcatttgttttattttagagttgtcttgagaccaggctttaattggtgagggagggatcaaggctactctttctcacgctgtggcctgagggtttaaaggaaccctaaagttttttttttttttttttttttgatgagtcgtgtcagctaagcccccatgcatttgatttgatttctctcaaggctatcatttttctggtgtgttaggaagttgtatcagaagaaagaggtcaggggatggagtgaagatgagaagtttaagaaagggtgattcgggaacagggcctgaatattccagttcaggtgtaggagatggaaaaatggccaaaaagtttcccggatacagagtgagaatgtgaaggtaaacatgcacaacacagccttagcttcacttactcattcccaaattcctgcagagcaccccctgggtgtcagcctctggttatggcactgagaataatcaccttcaaaggaattagaatgaaaattccacttggtgatgttcatctctctccacactgagattgcttctttgtattggggtataaacattacatacagtcacagtaaccttccttaggaaaactagtaattgagaaatccttaatactgttttcaaaaattagttaaacttacttggattccatataaattgcacgtgtaccttaaagaaaaggctgtttcttcctatcagatgggcagcatagcttagataaatgctaatttttctcacaattgtgaatactgtgattctgtggtatttcgctgggaaaacattctctcaattttattacgacctatattctattattttccatattgaaagctcagaaggtgtccaggttaaatgaagatgaacagcaatttgtgcattttttttccctctgagacaatatgcttcttacaggtagagacgatgccttttgcattatttaggttttcaaagcacttagcacagtgcttacaaatgggcagctctcaatattacgggataaagtaaactaaaacaaatcattgctttttggaattacttttctttcttttttgaaggtggattagtcctctgaatgtagatattatcactctaaggattcaacatactgggtgggtgttaaaatcggaaatgctttcttcatatactggcaggcttaaaaatatataagaatcagctcttggaggtaggggaaatactatatttggaatgaaaaccacatttataaagtcacaaatgcaattatcagccatctagctatttcctttaaaatgtggctatgttttcttcacactgtgtgttatctcaagccaattatgatatattatcagtttaaattaattgttttcaattcagaaaaaaatgaagcccatgaataagctaaactataataaaaattgtctattaatatttctcaaattgatttgtgagcatattgatgcagaataatggttattatttaaatagtagagcctatgaactccagtattcaaaggccaaaattcttattgagataattcacaaaagttgacaaaatctaagacgattatcctcttatcacagtaaacagttctgctgtaggacaacagaagagttcattgtagtttgcttaagatgtattcttttaaaatggaagagtatttggatttttcatgtggtaaaaacaatatggattgatgaaacatttgtctgtaaagtcaaaagcctgaaattcaaaaacctgtagctgtacacctgttcttgctttctgacaaaacatatatctacataggaaagagctaagaagggtataatgccaaggttaaaatgctaaaagagggactgagttgcttgaagaaacatgagtcaaatacaaaatgtaaacatccatacagtgcttgtagaagacagattcctatgcttttaagttatttatatgttttaagattttttggcaaatgcacatcaggctacgtgccctaaggcattgcctttgatgtttggttataaagcaatattactgccatgtcaggcactgatttttatttgagagataaatcatagtaccaaacccaattaccagctatatctagttattttgttttctgtacaatgtagttatcttttcttcacactggatgttaatttaggtctagtatgaaattttagtgttccagaggtcaaaaaaaaaaaaaaaaaaccccaagagatgaaacaggaggccattgcaggtgccaaggaaagacatactgagctctgtctaatactagcacacttcgaaaagttgtggaagaaatgacagagagcaaaatggagcctagaaaagtatagtagatgatttgttcatttgaattctagagacatctatattatgcatttacttttaaaaatgtaagaaaatatttttcatttagaagataataggtaatacctgcataatcagaaaagtattaggttgggtcagggacctaaacattcttgcaattaatttcaaagcctgctctctaagtcacaacctcagctgtgctgtgtttcatctttccaaattaaaaaaaaattgccaacatttccagtataaagttgaaatagaggatgaattcttgataatatgtatttactaattgaaccttcctacaaataaaattgccacaaatgttttaaatattgtatttacagtggctttggtaatcctgaaaggaataattcaacatagaactttaaacataacaaatgtaaagctactaaaacaaaggatgctttaccaattttataaaagaatatcgagaaggatttaatagagtaacaattttattataaacctgttgaagctaagccagcttttcatacattatctcttattcagtagagattcatactggatgtgttttatcagtaatgaatatggatcagcctattgaaatatgaaagttgacttctgtttcttttcaaatttattgtacgtaataataaagtatactctgacattatgtagtatccaagttaagtacttatttttttttttttttttttttttttgagacggagtctcgctctgtggcccaggcgggagtgcagtggcgcaatctcggctcactgcaagctccgcctcccgggttcacgccattctcccgcctcagcctcctgagtagctgggactacaggcgcccaccatcacgcccggctaatttttttttgtatttttagtagagacggggtttcaccgtgttagccaggatggtctcgatctcctgacctcgtgatccacccgccttggcctcccaaagtgctgggattacaagcgtgagccaccgcgcccggccaagtacttatttttgttgaacaatatttgtagtaaaaacaatatacagaatttgctagtactacccaataatacatacatacatactaaaatctttagctgctgaaatgggtatggaatattagttgtgttcaacaaaatatccataatgggataaattactattttctaaaatgttgcagcagaatacattattgctatagagtttggcctagtgattaagtaaataaacaaatatacttcttataaacatattaaaaatatatgacaaatgcaaagttgtaaataatcctatgcttgtccattatgaagtagtaaattttgaaaaaaaaaaagcccataatagaattacctgcttaccttaagcttttaaagaaaagaggacttaatactttttttttcattttggctttataaaaaagactaatttcttcagaagctttcatcctgcaaatgttggctagctcaccactctagtaggttaatttatgggatgaaccaggaactaggtagggactataaagtcacaaacataaaatgatgcatattcattaccacaaaataaaaataacagaattaatttcatttctaaaaaattttgtacaaatgagaatagtgactgaattttcttagaaatcattattttttagtccaatgcttcaaaaaacagtaaatggatattttttaacttaatagtcttatggatacagcaggatatagtcattcttttaatatacagggaagataaattgcataaaaatacacaaagcaaaccagaaatataaattttaccttacattagtaagaaagtatctcattaattgaacatttttatttaattactaaaatcctcttaaactacaacaacgaaaaaaacaaaaaaaggaaagattgtgtgagtgagctaaaaattgctcaggcagggggttatggtaatatatccttagtgccttcatattttgaaaagttatcagctcagctaactaaagctacatagataaaagataaaaagaaaatagaatcactcagtttatatttatagattaattagattaatttataggtgcacaacttcatcagatcatacaatttacaaatgcaggtaatttaattgggaaataactacggtaacaagtatagtgtagtggtaacttataatatacataaagcacctcattgagtcttcacaaactttctattatatcattttatcaaaactgttcctcattggaattttggttaaggatatgaaggcaaatacaggtgcaaaaatctctactctgaacagaaccctaaagaaaaagtgtgtcctacttcatggaagcatttcagttgtgacgccagaaagtttagagttggaatttctaccccactacttaacagctgtgtggccttgggggaattgtttaatctttcagcagctccagattaatccagtggtgtacaaattttgatgcacattaggattacacaggaagctttaaaaattccaatgccaggccacatctcatacagtaccaattcaattagaatgccttggggtacgagccagacatatatatttttaaagttctcagtgataccaatatacaccaaaatatgggaactgtgctggttaataatgtgtattccagggagaataacacccattttacaggtttgtttcataagtttgaaagaatacatggttagcacatagtaaattatatggcaaccaatatacctttagtaaatggtagcttttacattgttgttgttttaccacaataaaacaaaaataagagataaaaagtcgtagttggaggagactgacctcttttactacctggagacacatggtttaaacatatgctaccagttcagccatgttttacatgcatttggttttttttttttttttttttttttcacagaaatgaaaatggagtagaacatctactcccatttcccatgcaaaatgttattcaataataaaaaacgtgaatacatacataagcacgattattaatcatgagctgttaccaaaaatgattcaaactatcatgccacttggcatctccttaataccatatttatcatcagatatttctgtcaccaaagcattcaaattgtcagataaaaatctctgcctgggggaaatataaactatggcttcttgtaatgaatgaaaatgaaatgattccccacagtttattgccagactcactggaaataaaaattactaattaaataatcttagtttaaaataggtctgggtctgtcaagcacttttcttcattgtggtacaaaatgaggatgtcctacggaaaagtttcatattaacactttgataaatcagattacaattctgaaaagcacttttataatcgagtttttcccccactttaatatctgagtaatcttatctttaggataaatggagataaagttttacctgctggcagttttgttggagcaatcaacaaaatctcatttcttgaattccacaaatgagagtaaagtaacaaaccatttccccccaaattgaataatacctgatttctgtatcttcagcatatccttttttttgtttcatcatgacttatatttgcaataaatttgagaagaatgttaatattcattgtttctgatttctaaggacataaaggggatgtcttgggaaaaaaattcacaaaatgccccttggtacccagccaactcttttcataatctgtttttgagatttttaaaaaaaactatgcataactattgatttcttatgaagtgtcacataaagaaagtaaaatgagacagtttcagaaaaaaagtatggtaaattcaggaattgcacacctttgcacaagagttgtcaaaagcacatgataaaaaatttcaggtggtacaataaaatattctggcttttttgttctatatataggagtgtggcttttattttgatacagaagtcaagtgggtggcaatatccacttaaaatctctaaagagctgagtgattattcttaatatatttgcatcttccttctccagtcatcaacctcagcattgcctagcacttggctgactagtggttgaagatgagatggatggaaggaagcttgataaaacactactttaaatattttatcattttaataaagattgttaatataacacctggagtttaggactctgtttccttactccttcagatgacacagatgccgtggcatgaaaatcatctaaaaagagcaatttttttccgttgtcattattaattacttgtccatgactaaaaattccgttttacaaataaaattagaaattcctaaccttcctattagttttgttcttgagtatatccaaatatcatcctgactggaagacagcattttgaaagtgtatcagtagcattagaaaacaaagatagtttaatcacatgaaaccaaaggaaaatgtctttatacaggtctctttttcatgaagacatgggctgagtatgatctttttaaggtttgactgcacactctgaagcctgttggggttagaaatactaagcactaagtaaaaaaaatatgaaaaggaataatgataatactaaacacctgtgttcctaaaaggtctgtaatttcagcagaaagattgccactgagtcctcattcatacatgccaatgggtaacagtgacagtagggaggggattactataaaatgaaaagtaaatcaggctgttttaatgatttagaattatattgtgctattgtctacagtatacgttatctgtacaattagtttattaaggaggtggatattctctagtgattatactctggtgtacatacgttgagcattccttacgaatctgggtctaacccctccaacttagtttcattgctatctgcttagttgctgaaagtgagaaatcaaaatactgataactaattcagaagcttctatctggaaaagattttaaaacaacaaaaattaatattttaagtgaagttgtgaataaatggtattagttatatcagctattaaattatgtgctaatttcactgcttaactcattctcctatttgtcctctcttttctcatctagccaattctgttgtagcccagaatctcactgccagtactaccgcctccttcttcttaatggcgtcccctttattgatcctacacactgcattcagaataaacttccccattatctgaccagttcactaacttagatcgatctatctatctatctatctatctatctatctatctatctacatttttttttcaataggtccccattggtcagaaaaaaaaaaggtcatcctcttggctgcttgaaatttaccttctagcaatatcaaactgcaaaccttagactgaattttacttagatgacagtgtaggaagtatttttgcagctcatgcctctgtccttttcttcgctgtcccagcgttcccccaaacagagttatttgtgccaattctggggtacaaaaagactctaagcatatgtgtatcatagcactgagcatttaaatatacttttaatgggcatttatgtatttaagaatttgtcttccacattagattgtaaattcttccaaacaacagttatatctgggtcctgaccgataaatgggcctattcctcgcatcttataaagagcctggaagtaacagctgctcaaaaacatcattgatcaatttaattgaggcaaacataacagacagtatctccctctaggatggttctctaccttgcaatgcaaactcttgcagcattttacccattctcacctcaagtgcacttcactcttgtatatctcctcatccaatatctttctcttctgcaactaagataagtaatatctaaatgtgttgattcccttgtttaggtggactgtccataactctttcctgctccccttccaaaggtatggatttatcttttctctcacagatcttcctaaaaaatacaaatggagcctgcacatacatactgcagagaaaaatatgtcaggcattttggccttaaaacaaccccatggagagtatctttttattattattattatactttaagttctagggtacatgtgcacaacgtgcaggtttgttacatatgtatacatgtgctatgttggtgtgctgcacccattaactcgtcgtttacattaggtatatctcctaatgctatccctcatggagagtatctttatttccaattgtaattgaggcaattgagactcagagaggttaagtaactcccctaaagtcttacagccaggatttgaacccaggtacatctattaccaatgggtcatgataaacattgtaatgacacgctgggggtgttctgtttgctgcatatgccttaaggagtgtggagaaactataaaaaatgatgaggagggcacttagatgtcttgtttatgaagatgtaggacagtgatctaactcactttgtgttctccgtcaccgttgttctgccgtggttggactaaagattcaacatggactgttattcattcaacatttaactaatatttattgagcctcttctttgtgcaaagcagaggtataacatttaatactttagttttctaagattgaaagtgattttacagctgaagcaggttattagaaactaaattcagaataattttataatgagacatctgtagactaggaacatggtgaactgcctacctcaagaacttctacagccttatttttcctctctctcactgtgtattttctctctacaatttaataactattttcacatttcctcttttaagaaagcctattacagcatagtgcatttttctctgtttaagaaaatgcctcaggataaattgtggaggcaattattttcaatgctaacatcttcaaacatgaaaccagcatctgggcaattatgacattagtctgatttagcattaaaaggtaaaagtttatgtataaatttcaaaattttaagcattattttatcaagaattttgtgtcccaaccacagatcatttttgttgctgtggttaaatttgtttctaatagtcttgtgtttcatgtatgtacacaacaatccttaaatgaataagcaaataccaattaaacattcatatatgcataaacttggattttgcctgtatatttctcttttctatcatattcacgttaatgtagagccaaggctcattatctgtgtcaacagattagaaagtaaattgagtaaaataaatcaattgattatgtttacttcacacaccttgcaatcatttgaaaagttagttttaactcccatttctcaaaagcatgactaattaataacatgaattattaactgaaacatgatttttataggtttttacttctctctagtactttattgttaaggtagaatactaaaaaaacatcatttcaatgagtaataaaagcagccttgtagacaatttacttgtctatccagctcctaaaatttcaaaaactgtatgtactgtcatattcttggaagcagtggaggtgtgactagagtgaaaaacagtagttcctttttacttacatgttgttaaaaagtataagaccaatactatgcagttttctactattttttcttttataaaattcagtttaaacttggattaaatgtatccagttgcctgttcattatgtttaaacaagtgtttatctgcttcccaattttacaccaatcaaaatagatgaaggtaactttctccctagagaattcttactaaactcagagacatcttagccactcgactgcctgaacttatcaaatgcccaacttatccaggtatgcataaaatacttatgcaggtattttaggtattaccaaagagaaaattaagtacactgaagaaacaatgtctattttaccgacaaattttagatcggaaaagggatttggccaaccagacacaagggaagacacgttgtagaaagaaccaagtaacaatatgtaaatattatatgcatagcctctgatggtatgttacatgtgtcgatttaaatgaactccattttagaatgaaataaaattgaataattaattttgtggttcccaagtattcctgttcagatatggaatacttttgtaatcagaaaacatgtttaagaaaattttaatggaccttttgttcaaaacaggtgaaatgtcaacagttttccaagtgaaaactctatcggagatgctattgtcacctgctaagtggcacagagatgcccactagaaattaattgatagataattgtgcattagaaaaattactttattcttatcatattggcttatcaacttcattggacagaattttatgtgttactttgtatattgttaggttaataatactgctacccaaggaacaaaaaaaaatagttttactttttatgattagaccaaataccagaaggacacggttaatagctttgtgggaacttttgtagtgttttgcataatgaatgaactcaccaaagctcctatgacaaaatcctcctgactactcaaaaggttaaatgtgtataaatagatgacattttcctatactatgaagaacagttgaataatactaaatgaattgttttccttctcaggtacacttataaactgactgctttcttggtgttaaccttttcatgcacaatcccttgaactacttattattaattaatatgaggaatattattaaatttaaattgatcattcatgaagacaaggatgcagagtaaaaacagagagaagcaaaagttctaaaagactatagggtctacaaataggaataatgagaatgagacagaggggccagaaacccgagtagtatgtaaaccttcatcgtaatgtggttaacatacaaacttgaaaatagtcctcattttacagaggtaaactgaatgggtctgttttcttggaatcaaaaataccagacaaatgtatgtcagagcaatatttccagtgacttaatatcagggatcatgtgtcaattattttgatgtttgtctcatcacttgcatgatgttattgccacagccattttgcaaaatgtctaagtttttagacgataagtcatttctattgttttaaaattccagtttgacacctggaagtctgcaaaagcttaacttccttaaagaaagaaggtcatgtcaatgatagcgtcatatatgtccgggaagcatacacttccttaaataactctaggtgtgagtgaactctgatacaagaaaggaactaaatcaaaaaagagaattacatgtgtgtttagtggcagtaccttgatgatttgaaactgatgtgcacattaactagaaatttcactaagttaacaggcggacattctccctccccctgccccaagtacggagtgatccccattactttatacataatcctatgattctgaaaaactggtatgttttggtgaactcttataccagctgcattattctaaagtgatggtgtataaggcattggaaaaccaaagaactaaattgattatgaaattttacatggataataatcacttttaaggagactgaaaaggttcggttgaatatgctcaacttcagatagcagcccctgagcagcaggtgatggggaaggggatgtgggggtgaacaggtgatggttgctctttagtttacctcttttccttagtcttttaaatgtgggttcaagtccatagggtaggtaatttagaatacatcatctctctacaggttacaaagtgactaaatctgcacagttgaggagaagcaggaatgaattcaataaaagctcaaccctgctagtaagacctctgtaaatacaatgacaaaaatattgcttacaatttcatcgtctgctattttacttacatgtttttatacatggagctagagaacaaaattcagcagaaaggccaggactggacattcaatgaaaatggctcattgacagcttttatctccaaaagcttcatctacattattttgggagaaaatatcttttgaaacagataaaccattaactcaggtttctaaaccttttttatagtatggacctttttgtcagtctggtgaagcctaaagacccttctcagaataatgccttcaaacatataaaatgaaatacaaagaaattgaaggcaatcatcaaaatatttaaaaatatgtgacttatcaatgtatatgctgatctattaatacattaagtagtagcagatctactatagtttcatattagtgaaaaatgtcaatgttattttacatttgtgacatgtattatgtgaaatgaaaatatctgtgatttctattagtgacaaaatcataggtactgctaacactatgattggttgttgcctatatttgtagttgatgaaaattttaaatttcagtcatccaataatacaaataaacagatgatttttattttctcatcaaaggacacttctgtccacctatcctttgcgatccttacctagggttaaaaaccttgcattaagcactcacagagtgggactgagaatgcccttatattaatccttgtaggaaagtgctaatgttctggtaaacggaaaactattaacagtggcagaatccagaaataattctattggaaaaggaaatagcattattaagttactgccaagtaagtatgaggcaacacttatataccaaattgtcatttcggggatgtttaaaaatttttgtgtctgcccaagtgtaccagagaaaatataaagcaaattttcttttgaacaaaccaccacaaatatctctggatttttcagagctaagagctgcggtttcaatttttcgggatttcgtagttagataatagtgctgagtatttataggcttccttatataactatagttctatccatttttcttgtcagaatagtttattttctgtccctgctcctgttttccttgaattttagtattggatttactgactttgctctggctctccttctttttatagaaccatattcctcaagttcaatttatttttaagttggatactttatgtttccattccctttggagctctaaaaagaacgtgtattattgaccagataaagctattaaggtaactattatgaaatttctttttaggactttagtcaccttaatggttctttggggtttaagatatgctcaaagtagagtgcaccataacctgggaggagcagcctgtggctattattttctactcagcatctgctcattctggaacacttgcaatctggcattcttctctacagacacacaattatataagggccattaatggttttagcttccacattaaaagtatcttttcttaggcctgcattttcttgaccagttcctattctggaaacactcttttccttgctctaattctgtattcctcttctgtttcttggattatccttttattttatttttttcgtacctttgcaaatagaacttcttttgcctgatttaaattttatccttagccatttatactttttactctcttactttctcccttggcaatgctatctaatcttatcacttcatcattctcatgtgacctgtaaatctgaatctttgttaccaatgctttccttaactacaatatgcatttttaataactagctgtactatcttatcaggatgtcccaattgcacctaaaattcaatatgcctaagcagtgaaaaaggttgctgtgccctcattcttcagttgaagaagattgctttgaaggtgggaactcaaaacatgtatttggctttatgacttacatgctgctggaaaccattacttccaagtgtgctgattcagttgaaaactgcggctagggtcacactagctgttgctgtcactgccaaactcagctccatagttgccagtcaagttttattgcaaccatttggaacccttgagagctcaggaaatcatgccatcgtttgaaaaattgtgcacatttggtgaaagatcaggaaccatctatattctttcttctcttctgagaaaggcgtttgtctctgcttttatcagcagtgtgataaaagcggaaatcccggtggtttgtgctataatttccccattgtgaaataaccaattgaacctcactctgacagtcggcccaaaatttcacctaagtacccaagaacgccacattaacatgtagaagatactgtctggcccacaaattaacaatttaacagtgttccaactttctagtcccaggatgacttcttttctagtagtttcctaacagagaggtttttttgtgttttttgttttgtatatattttatttgggttgtccccctgctccttttgtaagggtgagggttggagtgatagctgaaagagtgatattttcagtttgagaaaaatgcaatatttttcaatcatccactacagttctaaattttatgagaactaaatcaagttatgccgttctcaaactctcttgatgtctgagtacttcatctttctttgtctttgaactggaaaatataagagcaagttttagcctggagaataaatgcaaaactaaattataatccctggacatatacagtttagcacataaggggaatgttgaaataatttgaaaacaaaaacttcttacggaatgtttcagtaattatttgcaattaaatacaaaactgtcaggtaatgagaatacgactccatttgttggaagtatttaacaagtcccacatggtctatttgaacattttgcagatacttgtttgtctttcctttactacattataactttaaggtacagtaggtgaaccttcaaagtgtgataattctgtacaaaactgttgtgtaacatttggaaaatcagaggcatctgaaggaagatagaacttccatgtcaggcacaaataatccaatttgcttttgttattgagtcaattttttgtgtttattgtttcaaaaacttcatcctgcagtaacgttgaaattgtttctttctttattgatatacttgcatagagttctggatttttttaactcacaaaaatatgttttaaaagaagtgagaaattaagttaaaataattatatattcaagtatatatggttacagttatttgtaaatgtatctctatatatttataggtagattttaaatgttatgcacctcagatttacccatagtcaattcctttatttatttatttttaatgttcacaaaaggtatcagcctgaggcaaactgtccttctgtcccactggagttttggattaatttttattttatgtatttcaagcaaagtagaacaatcttaagttaaattagccaatgctttcagagacaaaaatcattaccaaagtaccctgttcaaatttctaaaacagagcagatatttgttatatggaataaaataggattaaaattaaatatttatttttctttgtttctctttgatttcttgttacatttacaagttaaaatctattctgatgttttaaaaatcccttgtgattgcacaaaaacatatttataagatgaatttttagtatataaacatggtttggcatggacagatcacaaccccaaatgaaatttcatgactctatattgttaaggcctaaaagataagatatactaaaggtgctatcacatgttggttaaataacaatcttaactcatccactaaatattaagattcttaaagacaaaggatctgtttattcttgaggataaacaaaggatgtgtttattcttgaggattctcaaaggatctatttattcatcattttctttgtaaaattctcatctctaccacccctcctctttctgtttgagtatatactatacattcttatggtctcggctttcatgccactttcctaactcccccaaacaaaaggcttccctgtcataggctccctcttttttgccctcatggcacttaccatatcttatcattaaataatacataattcttttttctctctcattaatctgtatattctatgagagtaggaactgaattcatttcaattaccattgttgtcccggctttagagggtgaaacaatttgttgaatgaatgagtttattcatgtatgttcttgtaatcttgtacacagttacgctaagaaaagctcagtaaatatttgtggctagtttatttgatcatataattgaatacattcactatattgcaacatcagacttaggcagttttcttgtaaaacttatgtgtgttttcattctaattttcacttccttatagacaccttttttaaaaaaattatttacttcagaatttctctatgttttccttttgtcttgtcacagctggatagggaagagtaggaatttagtattatattatataaaactataatctctgaccactttttaagaaaatactggaattattaattctgctcttgtaattcactaaaatcactgcaaacattcatttgcttgtcattcgctaagatacctgatcaaataacagtgacatcttacaataactgcaaacatacaaaaagataaatcaaattgggtatttgtagttcatatgttttgatagccttttacaaaaaacacagcaactatctcctataatgattttgggtaaataatatttatttaaacttatattaatgccacaggaatttttaaacttatgtatctgtaaaacatggtatgtaggcattatacctaacatctacactgcttgttctcaaggacatacactaatttactaaagaaggacaagttgtttgcataaataataaaacttaaaatcacacattatgacaaaagaaaaggtgagatatacaggtatttttttttcaaataactaaaaaatcctatgtatatatatttatgcaattatttctttataacagttattgacctaggtgttttactaggtattttaggtattttacatatgctatgaattttaatctgcctatcaatctacatccatcaaaagatagtatcaattccatctgcagataaagaatctgaggctcagaaggggcaatgtacttgtcaggacatatagttacaaatagaaaatgtttaaacttccagttctatttgaatgtaaagcctgcactctttcctcttatgctgttgtcacttgccaaggccactcatcaagtgtaagtgtttttaatatgtagagtataataacagcatccctttaccctacaaaaaacaggatcatatcatgcttagggctgcaggctctgcaactgcaatgcctgggattaaggccaggttctgaagtttactagccaggccaacctatgcaaattaatcactcaatagctcagtctgctctataaaatggaatcagtagtaaagagtatctagtacaaagaatgctgagaggattaaaaaatcaatatttaaagtacttaggaaagtgcttgacacatagtaatgcttaaaatcaacatacatgaactggtgaaaagatacagtttagtaaacaaaaaagatttgcctgtcattatttataaatttgtcttttaaaaagcaataattaaatattgagcataacaatacaaatctcatcatgtatttatctctacaatgtttcagcaattttcagtgaacaagtatgtacttaaacaaatatacttggtagtacacattgatatcaaaagaaagaatataggggctgggcaccgtggctcacacctttaatcccagcactttgggagattgaggtgggcggatctcctgaggtcaggagtttgagatcagcctggctaatatggtgaaaccccgtctctactaaaaatacaaaaaaaatagcctggcgtggtggcaggcacctgtaatcccagctacttgggaggctgaggcaggagaattgcttgaacctgggaggtggaggttgcagccagccgacatcgcactacagcactctagccacctgggagacggagagagactccgtctttaaaaaaaaagaaaaaatatatatataatatatctttttttcatatatagtatatattttatatataatatatattatatatattttatataatatatattatatatattttatacataatatatattatatatattatatataatatattttatatataatatatattttaacatatattatatattttatatataatatatattttaacatatattatgtattttatatataatatatattttaatatatattatatattttatatataatatatattttaatatatattatatattttatatataatatatattttatatatttttaatatataatatatattttatatatttttaatatatattatataaatatacacacagtatatattgtctatgtttatgtgcttggaaatactagctaatttataattatggctaaaacagttaaagctgctcaaataatgagataagaaaatattaatttaccactttcaaaatatattcataggtattattttaatatccttatcacagaattcttaaacaactatataattatctagattattttattaaatttgcaaaaactggataattatgatatttggaaacatcacttagtccttactagaagattttagttttaatttttagtaaaaccctctgagatcacccaagtgtttttttgtttgtttgtttgtcataattgtttgtggatgttgcattataagagctcccttgaaatctgtcttactttcccaaagtagtgccagtgataaaaatgaatttgagtggcattcctgaaatttaataatgtcatatttaaacaaccaggagggaaatgtatacaggtattgtgggccacatagtccaataaatgagaacaatcctagttatttttagattagttaactaaagtgttattaattttcattgcacttaatctagtttaaacatcatgttcagttaaatttacatgacaaagcttatctgttcttatgagaatagttttctcattccaattcatcatcattttcaagctgtttatggaaataactgtcagaacacttgagcttataacatttaaaaggaatgagggtctgcgcgcagtagctcatgcctgtaatcccattactttgggaggccgaggtgagaagatcattcaaggtcaggagtttgagaccagaccaaagtgctgaaaccccatctctactaaaaatacaaaaaaaaaaaaaaaaaaaaaaatagccaggagtggtggtgcgtgcctgtagtgccagctgctagggaggctgaggcaggagaatcacttgaacccaggaggcagtgagccgagattgtgccactacactccagcctgggcgacagagtgagactccatctcaaaataaagaaataaataaataaaatgaacaagggaattaaattaggactttaattagaagaattgatgtaatggtgtgataaatactacaggaacatctaaatgattttcacatattaaacgtaattttatgtaaaatataaaaataataaaacttaaccaaaccttgtaataaataaataaataaataaactaaaaaagaattgagatcttccaaagtaaataaattgtatgaatcacatctagaagtctaaactgaaattatttaaatcagaaatatgtattattgccttaactcccctataagtataattagaaaataattacttaaaaaactacaggaaactttttttgcctagtattaaaaggtttattattaacatgaaataatttcattgttattgaaaatgttcaataggtaattgatttgcataataatttttaccatgtaattttgcaacaggtcataatagagttagatataaatttattccttacaaagtaaaggtgcttaatagctaaattaattaaagacacacattacagtaaataattcacagttatttttgtaatatttatcaaggtaatatctcaacaaaaacatcttgcttttaattgtttaacttaaatatatttgagtttttaaaatgtggtatatcactagttttgaaaatatttcatttaattgtattggcaaaggcagccttaatatacagtttaaaattgaaagtctggtaaaaaatgagggaaaggctgccctctgggacatgcatgatacaaagtccagaagaaaggttgtcaatcatattccagggtagaaaccagcacaggagttatcatctatgtattgtcaacaacttccaagatcttaccttcaagcagcttagagctggtaccacctgtaacctgtaggtgcttatatgtaccccacagtaagcaaattctctaagttctccatgtgcaaaactaaatcattacccctttttactctagattttctaaaatctcttaagagactacagaaaaaagtagaaccatatcctaagaaacctagacaatagacagaataaagatccttaatttgttatatgtccttaaaatttaataaaataaaagcaaacaccccaataggaaaatattttagggaactctctaggtgactctttctgatctctttgtcagcacacggagaatacaggaaatgctagaatgccagatcatatgacagttgaagggaggcatgccactatcacatgcatcttcaaagagatgtctgaatttaaatataaatgttgtatcaatataaagttaattcacagaaaagcaaaggttttcattaaacacaacatgaaaaactggttggaagacactaggcacaaactaatgacagggcaggggcctctctccctctttcatagccttactgtctgtctcataaacccttcatccccagcctatccactcgacctgtttccctattcctccatgccctagagctccacattctaggtctcctcttctaggatatccacaccctcatgtgccacttcttagactcattcatcactgcagagtgacactcattcctaggcagggttcttatgatatgtcccccattcaatcctccttttaggaaaatgggaaggcttctcccccgcaattgttcccctagtcaggcctcctatgggtcagaggtggtcttaccctgcctagacatgctctaatccaggtattgttttaatctatgccgaagttccttcctggaaggttctctattcaggtacaaattctctatttttgctgaatgaaggtgaaatagtcactgacatcagtttttttgttcatcataatattaataagatgttcactgacagacatcttggaggtgctttttagcacaacttccagtgttgactgagcagccatcttcaaattccatgaaacagaaatggatgcaagtgctgtgcctgggacaggccaaagagaagctgaacctgagcttgagttaacttagtgggtgattagttaaatgcttcacgggaaggtttctaggttagttggttggatgactattggtctagttggctgtatggtcaacctacttactcagccttccctttccatccttctgtgccctgcacctttcttcatcaactcatgctcaatgtccttcctcaattactttaagcttagaaagttttttttttcccaattcaagatttctctatgatattcagagtttaattattttgtgtggtttgtcaggactacagtaatgagcatcccattttatatcattattttatttatatatacttatatatcattcaacaatatttcctattttattttataaataccatggccaaagagaaagaaagaaaaagaaaatgagaaatacatttcttactatggctgaagagaaagaactatgtggtatgtgtctgtgtctgtgataaagaatggacgtgtcatgtatattcatgtttatattatacctctctatttaaacaggtatctcagtcttgaggaaaatacactgagtggggaatcagaaacctgtagcactgcttctctcactaaatagctgtgaaagcttgggcaaacaacatcaggtgtgtctcagtttgtgcatctgaagtctcatctgcatctacatttggaatttgcataatgttgttgtggtgctcagatcatacgatatacatcgaagcagtagcagtatgaactttcctctaattgtccaacaattataaggctatagcactagtattactaacctgtgtttgggcccattttaggccccatcccattgactttagtcctgttactacttttttcccagctttttttttcttttttaggtaagtggtgctttctgcctctttgtaaacacttaaggcaaataactgccctgtcatttgatgcatcatttcaagaccctactttcttcagcttccaataagacaaataaatagtgtgcaacattcttgctagcgtgtgggacggcccaaatgcatcctcctttatttttacgttttatttataacagaggctaactgatttattttatttttatttcgtttcttttagagatgggttctcactgtgttgcccaggatggtcttgagctcctgggctcctcttgctgaggcctctaaaagtgctgggattacaggcatgagccagtgtgccctgtctatctggtttcaatgccctgaatttactctcagaaccaaagtgtcactttggtggtagaaatttcagtcatatgcataatcataaaccaaaatgggattcgtggaacttgagtatctgaggaaatgttatcattcttttcaggtcacaagataccatttctatgcatattgtgcactaaatgagacaccctagagaatatgtgtgcattaataacataccacaaatatgaaaagtgccatttcaatggattatgcactctgaaggcaaataatattgattttggcccagatttcaaaataaatttagatgatgtacataaaaatatatatgcatacatatatgtgtgtgtgtatacatacacacacacacacacacacacacacacacacacatacacacacgtgaatacttactgtattgacaatttcttcccataaattcgcctgggcactcacaggaatagttagcaacaagatctgtacatattccaccatttttgcaaggctcaacttcgcattcatttatgtctaagaaaaacagaaaggacagaggaagagaattattggtaaaaaatgattagatattggaaagttttaacatttgaaatacaaatgtcttagtaatgctattcctttgtgtgtgtgtaggcatgtgtgtgtttagtcagtaatacaaatgctgcttaaaaccaacaatttaataaccattatatttaatcaatttcaaataaaattcagaatacagacgaaaggccaatggaactaaaccactctcccattctgaaaataaatatgagtagtctggggaaatattcagtgtatccttagaattaaatcaaacaaattaaccctgatagaaagatgaattggtttcacttacaagatcgagaaacctcccctgcagcaacaactgccaattaacactgtctcatttcatcttaattcattacaattctaactgacagagatgttttagtttctaaatagttcgtctttgatgaatacgatgagaagcaaattagagttaatagctaaagctcgttacatgcaaagtataataaatgtaaatggtgatcacttcctaatctcattcaaggatttctaaagtgaggatgactaaagggacttacctttgatatactactattacatctgatgcaaaatcacatgaaacataaaacatcgagcaaattatactactttccttgctaattttggacaacagagaaaacaaatatgactttgaacacaaaagaaacaatgactaattcaatcaatcacagatattcacaaatcattcccttttagcaaagcaccatgctggattctgtgggagccagtacagtagttggagagcacacaccactccccatctcttcctcatcctatgagctattccagttgagctccctatctgctttcatttccataacagtttgttgttgttgtttttaactgtattacagacttggaaattgtctgtttatatttagcccctttcaccttgtcagaaagtgagctccacaaatgaagttcctatcttgccctgttccttgtattcctgaaaatgccacactccatctggaaaactactgaggctcaataaatgtttcctgaccaactttctaccaaaacaatagaaatagtcatgtgcacaatcttaaaacattttattccagatttgtaatgtgccttctgataccctataacatatcaaatgatagttctgaagtcttgggctattacagttgcttaaagcaagaagatcattaaattacttctaaaaggaaacaaggaaaaaagtatttgaaaatctcaattttgccctttcttttgacattttttttttctaattagtatcccctccagaaagcagagttggtcaacttctcattctaagttcactgtagaaagcctggtctaaatttccttaggtaataactttctctcaaaaagcagcccttttggtttctggttgacaatcatagcttaagaacagagataattcatgactgtgttcagaaaaaataaaaataatttgagtacctcataacttcaaataataggataaaatcagaatctgctaatctctaaaaagatggatctgtgtgctgtaaagtatgatagactcagccgggcgtggtggctcacacctgtcatcccagcactttggcaggccaaggcgggtggatcacaaggccagtagttcaagaccagcctggccaacatggtgaaaccttgtctctactaaaaatacaaaaattagctggtgtggtggcgtgtgcctataatcccagctactcaggagactgaggcaagagaattgcttgaaccctgaaggctgaggttgcagtgagccaagactgagctacttcactccagcctgggcaacagagctagactctgtctcgggggaaaaaaagtatgatagactcctaaatatttgatactgaacctgtacaaaaatgaaggatggatgggagggagggagggaggcagtgagggagggaaggagggagggaggggaaagaaaaggtgagtataagtcatttctttcctttttaaaaatataataaaatctcagctctctttgatcttatcaaaatttcacttagtcttaatattaaactatatttatattggactaacacacaaaccattttcattaaattttgtaagccacatgaaatgctacttattgttgccaactcaattatgcatgacaataacaatgtttggctaccttggaacatgcccaatatgtcttaacctgtatcctctctactacaatttgttttagatgagaacgtgtaactggttaatgtcttcatatcttagagaaaacactgccgtattttgtaaagttagatgcaaaaatttattctcatatatacttagagagaggaaactaagtggtcatgtctgaaggacccacataagcaaaagataatttgatcttagacaagaagaaaaagtttaattaagactaataaggatgtgatatagatgacagtcaatttccaagcagggagccagaatgaatcacaactttgaagaagaatgttcatgatatgatcgtgtgtttaggtacaggagtaaagcattttggagcagagaagatgaaggagagtgctagaatcccatgtcagagaatgtagatagggaacagattatgatgaacccttagtgcaggctgaggcaactgcgttttatttttttggcaatgaacatttggagcaggatgagaaggattaaagggtatttccttcacccttctactttagaagaacctagtgaagccatatgtgagatggacttgagaaatgaataaaggaagatgggacagaaacccacaaaagatttgatgttaataggtacaacatatattttaagtctcatgtaagaggctctatatattttctcattttaagattgaaatatatcatgagtaaaatcaaacccagctcttgctgatttgtaatgttaatagaaggaagttctcatagccagtgtgagaacaatcaataattattatacatactattaacgatacaaagacactgctgttttttgcctccttaaatcttccaagtctttacaccgtaagtagtaattaaaatatgtgagcgtaaatctaattgagacaaatcaacctttaaaccttccagttataggctcatcaggccccatctataaatcatcagcaaagcaagttataattaaggacatccgattctaaaaaatcaacagttaacacctttacccagaggttaagatgaagtggaatgaattggaatgcatttgctgaaatggaaatgctttgtagacacactcaatttgtgatagaatgaccttttcattgtttaaatgtgcatttttcaatgtttttaaaactcaaaaactacttaaatctaaattcataaaaatatacatgttatcttaagttatccatattttttaatacagtagctaagttagtaaaacatttctgcataggtacatacccagtaatacacaagcttagaagacagttgcaaattacacagaagcatttacgtatttgtataatgcaggagttctttcagcagtgaaggctatttgcactgtaattaacactgcaagcaatctaaatggaaactgacctcaatttgtataaatcatgtttaattaaagactagataaaaacgttcacagaatatagtgcaatgaaatgaaacttaaacatatttgcaataaataacatacacctatcttcgtcacagatcaagacattatcattgccagaaaaaagtccacatccattccaaatatactactaggttataccatttaattaatgaagaaaaaactgataaagtagcccccatatgaaatagaaatttccatatttggtcagatttatagtttatttataataataatatcatttataaggtcttgcttcataaaacagcttcaaaatatgactttataatcaagacagtcagctgagtcctgaagttataaaactttgctgccaaccttcttgtgtcactgaggcacagtgatgagagctgcacatgagtttccaggtataaactcatgactcacccttgtttcctgaaattatatataatatatataatttcatatatatgaaattatgaaatatatatttcataattatatatattatatataatatattacatatatgcgatatatatgtattacattttgttttgattttttggtggaagaagaaagaagaagaaagaaggagaagaaggaagacagaggacagaaaataataaaaggtaaatagttgaatttctctgaaaggaaacacaaattactttgaaccaaaaagtactttacaagtattcccagttccttgcctctgttataactaattacacagattcattgattttatatgcataactcagactctttatcggtatgtcatacataacccacattacagatttgtaaatgtgtttgatcgtccttctctttggcttgggttttttcctagcagaaatgcacactctggagatttcgctgtgagaagcctactccagtaattgacaaactactcatatatatatatatatacacatatatatatatatatatatacatagatctatctatctatctatctatctatctatctatctatctatctatcatattgagcactcctcccttaggcaattcaccttatgcacatccacatcctgagaaatgctcagttacacctggtcttctttgtcctggatctttgtcagaaccattattgtacagattatagccaaaagcccatgaaattgactttggagtggtaggctgtcaaagagtttttaaaatggaaattatatttgttaattccttattggtgccttcaaaacaatgcattgtctgggcatgacttcttgtcacagaaactgtgtggcttcttctcagagaattatattgaaaaattcaataatctcattcttcattacagattccgctagttggccagagatgaaacagagaattcttgagtctaattcccaggaatctccatctctggagacttttaaaactaattagtaagtaattaattagtttgttttcaactggctcacctttgcaatctgcagagtaggaatggtagcagttttcacttctgggacatcattatcccagttcatccttgagttctctcagaactcctcaggaaaatgccatctgtcctcagtagtttagctacatttaattcaccaacatggcttagatattttgaatactgaccaccatttggaccaggacatctaatccttctggggatagatatctatctaacctcctcctagagaagacaaagacaatgtatttcaaccataaatctatctcctcttcataagtaagtacattgaggcccccaagaacatcaagaaggaacatggttcttgggctgaacatacttttttggatatattaaaaggagacaatgatagacggtgcccccccccccaagcttttttttcttttgcgaagacaaatttctcaacttctttatgtctttcccttgggctatctttcctccggcaatattgttattgactgctaattgcttggcaagaccttatttttcagagcctgctattttttgatccttaacaacacatcttccctgggctccccattagctattacatattctccagacctcccatgagtgattgccttttaaagtttgaccttttatatttttccttatttaaagcctatgatctttcaatttctctttaaagattgaatttctatttaagatgaatttctaggaatttgattctcccactcagatgctgaacttaattatgtcacaatcagaattatctagataatttatttcccagtcacttctgtgaccagtttagtatatatttgaatcttctgttcttgaactcccttttgatgtggctttctgctatattactagtaattcattttaaagtggctaattaaaatcagcattattcagtcagaacgtatcacacacaaaccttttataataatttattgataaccttcacttacaagaacagtagcataacaaaagccccaaatccaagagatatttatccattgtctccatctaataaagatcatattctctgtccatctctatcctgacatcctagtatttattttaagatctttatttagatgcaaatgcctttgatactagtacgcaggcaatattcatcccaattatctgggttgtttatattaattattccaataaagttttatttgcatttacacagatatttggccagtatgacaagacagctattccaagggatataaaagccaaaatgaggggaggtagaggaggggttatcaagagggtgttatgtctctataactcaaatatttgatgactttaaatatatatatatatgcagaggccagtaagaacagatgcctctttcagtaaacattttcacaaaagagcaaaccacaacaagggatgttacctcagtggcatgtagcatagtcactggccctgcaataaatatttgttaattggtaagaaagaaccgggaatattagtaaccttgggatcatcatgtatgtactgtaccagtgagtcccttgcttggggcaggtgctccagcctatttctaatgggattctattaaggaaaaatgaaattagagcaatgcttcatttaaaagttggagctcttaaagcatatcaatgcacaagtcatgcacttagagattgtgacttaaatggtcttgggagagacaaagggagtaatatactttttaaaaggcattccagtgactctgaagcatagccaatgtttgcaaacactgaacagaacctctgcttatgaagcacatccatccatccacccttccttctttccttgcctcccttcctccctcccacccttcctcctttccttccttccttccttccttcctcccttcctcccttctttccatgcatccatccatccttagttctacactaggtactaagaatgcaacaattaatatgtcacaatctgtaatgtttctgaagctcttacagtagagtagatagacaaggaaacaatcagttacagtgtaaggtaacaagggctataacaggaaaatgcacagactctcaaaggaactccaaatatcaaaactaaattggtctggcagactaggggatgttgagttttagagaaggagtctagctgactagggaaaagtgcttttgaattacatggagttataaatagttgactctgtaaagttatttttctaaattaatgtgtatttcatttttcctggtatcagttgtctgcagatctaagagtgactcctcattgtcccatagttcttttctccaagtgtgtaaggtatatatttcctggtttcctatttttattattatttatacaattgcatattttaatgttttatctaaaattaactactctattctttcagctgcatgtcaaattagttctctctctggttttagcagtcaatcttaataatcaaccattttggagtttttcctatagtgagttatcagaaaccccaaactggcttaggtgagataggatttgtattagaagctcagctatgattcacatagcttgactttaaccatttgttcactcattcattcattagaattctgagaagcactttccatgaatcaggcattaaaatacataattggatatatctgtaaatagaagcagctcctgttctaagagatcattcattttctattcttctacacaggagacagacaattataatacaatatggtgaaatatgtgctttagagcattatgtacaaaatgtactaagattatagaaaaagcagtagttttgcctaaaggagatatggaagattgcttgcaggaggtaatacatttggtgcttaaaggatgagcaggagtttttatagctgtattaaattaggaagaaacacaaagaacatattttcagagagagctgagcactttgaatttctgaagcatgcacagggactgtgcgaggggatactctgcataatggcgaccatgtagtctgggaccagatttttatggccgtatcaatcaacttaaggagtttgaactttagtccttggatactggagagttaatagagaactcaagaagggtggaaggggacatgggattgaatagatctgcattttagaagctcattcacattctctaaaatttcattactggtatcattttggaaaaataattcaaaaagtgagaagggaaatttatgttgagtccatatcactcagactaggtagtaggatggctataatcacgtttggtatgtttaaatacttagcttggttcgaaatgtatatagacttcctaatatttacggttgctagatttggtaaataaaaacagagagtgtccatgcaaatatttgagacatatttataagaaaatctttgtttatctgaaattcaaatttacctgggcacatttatctagaaaccctacctgaattgtcaattggatgtgatttctccctattttttcttccctttcctatgagcattttaattttcagcatatggtcatgctttacattttgtatattcagcaaaccctaacaaaaactacctacagtggaaaatcattatggaccaagaatcttccttaggcttttgctgaaattaaaatttgttgcttgcattctgtttataattttacagtttacctctacataaggtttaataatacaagtatagccaaacagcactacaggatggcagttaatggataacaattagcacatccttccacttgtagattacttattatgtaccaaacactgttctaagccttttatatgtattaacacagtctacaagctaaatgttattattattatgcctgttttacagatgaggaaatcaataaactgaaagtgtaaataagttgcccagagtcacacaggtggccaaactgagattaaagcccagataatttaatttgtctccagaatctatgctaatcacccatatgtttcaccatcactagggaatattagtactcccacttcatcacctcttcttaccagccttcaaggtattattttatgtgctaagaaggacagatataggataacacatagtccttgttctcaaaacgttgataataacctaatattggcatttctcctctaggttaaagactccagtcctaaaatgttagtttggaatacacttttccccaatccctttattcgtcttagtaatttcctcaaaatcctaagtggcttgggtttaatgggcatttgttccctttttattcctgaaatccacaaccacttgcttatgtaaaaatgaatttccttgcctcctacagtcttttatacatatcttttaactttacactcagatgaaaggagttacatttgttacacaatttcctttttagagggcattgatatatttcatacctatagaattaaaattttgtcattttttttctcggtcacaattcaccttatgtaaaaatgtttgaaaaatagcatatatacttaaaaggacacaaaacagtaaagttacaagaattattataaagagacaacccatataacaaccaccaagggcaaacaccagaatcctgccagcagtccaaagccttcatgtgccacattcattcaaaccctcccctacacccacataaaggtgacagatcccctgcttggtatggaagtcacagacttgctctttgtatagtttataatttcgtctcctaaatatttattcccaaagagtttatttttgcctgtatctaaactttatagtaaaaaaaaaaattctgtatgtgatcttctgtttgtggcatctttcaaaatgttgcaggtgactgcagtgagttcattttcactgcagagtagagaaattgctctagagtattttaccataaaatgtaccatatgcttttttctttctatggctaatggcattagtagtggtgttggaaataaaagcatcagggaacatgcatgtacatatctcttgacaaacaagtatgttgaatttttttttctgggtacacttaggagtgaaatggaggagtcataataatgcatatatttaactttaatagataatacccaactgattttaaggtggttatgccaatttgcactcttatcaccaattaataccacttttgaagatacaaactatatgaaacttgcaggtaaccactatttcactttatgtggaagtggagagtggaaaggcttaacaccaataaatctttttaagatacgtttttaccaagtggggcttttaagggaatgaaataaaaccttcagttcaccaagttcaattacattttttttcttcaatgaccttaacttaaaaaaaaaaacacctcacactaaaaatgcctaaccactgaaagcttgtaagtaatgttacatttcaataacaggcactgatacacagttaaattttgttatacagaaagataattttgcctaacccttgaattaatttcttaaaaggaacctaataaatcaactattatacacagatacatgtagactcagataataaaattaagaatacttcctgcttctatattctgatatctttgaaattttatattatgggcataattaaacaaaaatgatgtcctaaatgagatttctaaattatcttatacttctaaagctattgtaaggattatattatacttctaaagctactgtaaggattcaatgaggtaaattatgagaaaaatatcttgtaaactttaaagactgcaaatataactgtccttattattatatgagttaaaccatattcatattgtttgatagagtgtttcttggttatggccatggaggaaaatataggtgaatttctgatgaggctttctgtacacacatacttctacatttgggtttatcatcagagtaaataaatgggtagaatttttataaatattctacagaagagtagccctgtcttggagaggaatgaaaggcagcatttatccaaaaaattgcaaagcatgtggaaactttaatacactgaatgggataattcaacaaatactcttaatatacttctttccaaaatggtgacatttactattttttaaactaacacaccaactctttatcaattttggctgatagatcactgacatctgtagcttaaagacttaaattggggttggtaaatacagaaaagactccttttttaaattcttaggagtttcagtcctcatcaaggtgaaagagctgggtggctagatttccctcattccagaatctcatctacaaaattataggatattttgtgggttcctggcagagctagaggcaacaaaacatctgttacactcaaggccaccatggaagaatctgcttcaagcaacaaactcactactcagtgctaaaaatgctgtctccaagccattactttttatatatttttatcccatatttattggtaagtatgccaaatcagcatattttcttcattaaaagtgataattttgggattcatgagaactctgcttctggcctagacatagtaaaagggaccagaattttcaggcagaccctcttgttttaaaaaacaacaaaaacgacaaaaaaaaaaaaaaaaaaacctcagacaaaatacgtgagacaacagtgttgaacatactgaacattaagacacaaaggactctccctcttgggccatggcatagggagggagaatccaggcagagcctggtgaactctagtgaaagagagggagctgggagtctggagagtcgacggaggctagtgtttgtagaacagaatatacccaacaggagagaactacacagagacagttcaccacagagatctgcagtcctgaacactgccgtgctctctaaagtactcagcagagggtagattagcattcacaggggagcaaactcctggggaaagagtcatctgaatagaccagagggagcaatacttggagcccacactaggccaagagaactgccaattcccaccactaagactggaaagcaaactgtttcatggggcattgggcagaggacccagaatggttttgtcttagtagtgggggataattaaacctggattaaataaattattggtcccacctaacgaatcttataagcaagacctagaaggatcaaactgtttccaaataacctaactatataagaaaactaagctcaagagaatatataggactacaaagtactgagcactcagcaagataaaattcatgtctggaatccaatcaagattaacactcaagaaacaaaaaagatatagttgaaaagacagtatatattaaaattagcagagaagtaattaaaacagttattaaaactgtattccatatattgaaaatattaaatagagatgtgaaaaaagaaagcctaattgaacttccagagatgaaactaacaatgtgtgagatgaaaaatatgccagaaaggaataatagcaaattagacatgcaaaaataaaaaaaaattttagacgttttaagacataccaattgaaaatatacaaaataaaatatacagaaaaaaatctgggcatcagtgatcagtggaacacatatagttagtctaaaatagatgtgattggagtccttgaaaatggaaagtataaaatatttgaatagattatagcccaaattttccaaatatgatgaaaactatactcacagatctaagcagctcaataaatcccaagagtaagaaacacgaagaaagctacaaaaaggcacatcgttattacaaaagacatcaaaattattctgtagataaatgtagtcttttcaaaaaatgatgctgaaataattgaatatatgtaaaatacacttagaactacataagaaatcactcaaaatagattgtagattacaaagtgaaacttaaaactattttttctatatcaaatccataaactcctgctccccaatgtcaattttaagagaattaaaagacaaaccacagattgggagaacatatttgcaaatcaaaaatatgataaagaacttgtatatacaacatataaacaactctcataactcaacaagaaatcaaataattcaataaaaagtgggaaaaatatttgaactgacagttcctaaaagaatatacataagagtggtaaataaacatatacaaagatgttcaacctcatttgtcattagagtatataaattaaaagcagaataagatgtcactacccaacgattacaacagctaaaattaaaaagatggtgttggtgaggatgtggaggaattgaactctcatacactgctgttctgatataaaataatgcaatccatttggaaaaccatgtgacagtttttcaaatacttaaacacatgtctaccatatgattcagccattctactcctacatatttatccaagacaaatgagagtgtatgtccacacaaagacttgtatggatgttcatagcagctttattactatagtaataaccccaaacctgagacaacctgatctcaaaatagttatgctgagtgaaataaatcaggcaaaaataatatacagtgtctattttatttatacaaatttctagaaatgcaactaatctatcatcacagaaagtaaatcagtgattgggatgaagttgaaggggcaggaaggagggattacagtggggaagaaacttctgagggtgatgtgatgcaaatgtttagtatcttgagtaagatgatggattcacaggttcatatatgtgtcaaaacatatcatattgtacattttaaatttgtgtattttattctgcgctaattatactccaataaaaccttcaaaaagtgatttttataatccacatattttttgtctgtaaactaagaactgcatacacacacacgcacatacacacacacacacacacacacacacacacaccccgacactccatgacaataaaaggcccacagaactaatgaggaacattagccttctcaaattcacaaaagaaaggtttttgtacaatatacttttatttcaatgtgagaaccatgcagtccaaatgaaaagaggcaggtcttatgggagagactgagtagtttaataaaacatagtaataggaggagctgtattcataaagatgagaaaaatactgatttttaaggtagtttacttcctactttgcaggttgtttccaccactcaagaaagtctttgcaagaagctttaaataaagatgaatggggaaaaattaatgtaactggaaaaaattagtatcattgcaagattttctattgctcttatatttttggtttcaggttgaatttgtttttgttatcattgactatcagaaatctgaagcatataaaactataacgggggttagctataccttccctaactgttcttttccagaaaaattttctgatggaagttcatgaagtacattgatgtgtatgttttctgtactcctatgatctattcaagagattgtaattttcatacaggaactatgaaataataataattttctagttctctttgctgcttcttttttttttttttcttttttttgagatggactctagatctgtagcccacgcaggagagcagtggcacgatctaggctcactgcaacctccgcctcctgggtcccggttcaagcaattctcctgcctcagcctccagagtagctgggattacaagcatgagccaccatgcccagctaatttttgtattcttagtagaggcggggtttcaccatgttggccaggctggtcttaaactcttgacctcgtgatccacccgcctcagcctcttaaagtgctgggattacaggcgtgagccactgctcccagccctctctttgcttctgtgaaggatataactttaaaaacttataaaaatgtatgtttaaaggagattttcattattaatttcttttaatatacattaagatggaaatttcaattccattaattacatactgcataattttacattgaaaaaggaagccttcaagacaacaatttccatggtatccaatgaacctgattaaaataatgggctatctccataacaagtgcttagataaatggtcctattctgtcagagaggaatgggtcttattagaaactgcattgctctgttatgctattataagattaatgcagaaaaaatgtttagttccttttaataaaatccaatgacttgtgaactggactaaatgtcagtaaatagtaagtgtaacatcgtctgcttaatttggttgtttaatttggcccttagtataaagatttgagtttatgcagcatcttacttccctacactcattaaatctccttctgccatgtttcagagaataaaggagggcttatgtagttctgattaaataagctacagagttatctttagaggtgatattaatatcttcccaaactataatccatccttgaggtactgcaatattttaaatatttttgtaaagacatgcagaggtagaaaaaagactaagatatattgatgaatttattttattgaatataaaaatacatatttttgaaatctttagaacactatagatactaatatactatactaaattcatatgttatgaaaatacagaggttactgtaattttgtacagataagcacaactggaaccttattattatctatcagccatatatttctgtgagtgtacaattatttagcccatggcttttattttattctgttcattaccaatagctaacatttctcattatacaaacgggaaaataacccctcaaaactacctcttactttatactccctatagaattttgttaaataatgtatttaaacctactacttgttcatcagttttagccattaaggctgctacaacacccttcatatctctttcttggctttaaagtcctattgttattattcttttattattattatttttttgagatggagtctcatgctgtcacccaggctggagtgcagtggcacgacctcggctcattgcaacctccgcctcccaggttcaagcaattctcctgtctcctcctgagtagctgggactacaggcacctccccaccacgcccggctaatttttgtatttttaatagagacggggtttcaccatattggtcaggctggtcttgaactcctgacctcaggctggtctcgaactcctgacctcccaggttcaagcaattctcctgtctcagcctcctgagtagctgggactacaggcatctgccaccatgcccagctaatttttgtatttttagtagagatgggatttcaccatattggtcaggctggtctcgagctcctgacctcaggaggtccacccacctcggcctcccaaagtgctgcgattacaggagtgagccaccgcacccggccttgttattatttttaacatcagaatttgatttacattttacaacatattctgttctgtagtcatgttccagtgaactacagctacagttaattgatataacaatcacaaaacctccatggcatacgatactcatgtatttatttctcagacatctgagtgttgctggggagtggtgtcaagagatctagagtgggctacactaagctctactttgagataaaggtctgctgggcttggttccttgctgaggtttgggctgaagtcagctccctgtgtgatcattcagagatccaagctgagggtacaacagctatcttttgctcctttgctgtgatgatggaagaagttccgaaaagaaaatgaaacatgcaaagcctaggctcataagaaacttattgtcatttcgtgtcaatggccaaaccaagccatatctccaaacccaaagttaaggggtgagaaaaatatatttctccttataggaggatttaaatgtcataaaacaagagtaagaatatagggaggggcaaagaattggggcaataatgaccattttacattaattcctcaatatcttgtctataattggttgtaaaaagtggaacaatgagaatacttaccatacaataattatatgttaattattgtagaatcaagtaaaaaaaagtcactgcacttcactaaaaatgtgccactttatggaggctgttctagcattacagtcaaatggacttccttctgatgcattctaccaattgtttaaaatcacgacacatttaatgcttcatatttatagtttttttttctggaatatttaatttttttttttgcttgttaggagaagtataaacttattcaccatgtcagtatttttattgaaatgtacttccatacttcttgaagaggcctcctggagccctcttctgcttctgctttttttttttttttttttttttaaagacagagtctccctctgttgcccaggctgaagtgctgtggccggatctcggctcaccgcaacctctgcctcccaggttcaagcgattctcctgcctcagcctcccaagtagctgggattacaagcgcccgccaccacgcccagctaattttcgtatttttagaagagacggagtttcaccatgttgaccaggctggtcttgaactcctgacttcaggcaatcctcctgcctcggcgtcccaaagtgctgggattacaggcatgagccacgcgcctagcctctgcttcttattctaagtttagctgattcctttctaggtctgctgcaagctccatcctgggatatcttctccttgctcacctgggcttattctaccctttcttggatcctaggtttctattttttgtgtcctcttttcatttgcaataaaacatctttaggtaattttcatgaaaggagtaagtataacattattttgagccttaaaattgtcccaacacttgaataacatttggctagtcatagaagtctaagttcaaattcatatatccccagaaagttaaaggtacattaattttttcatcgtcttttaatatatggttgctgccagagacatttgaagccaatataatttttgctacttttgagttaacctgttacatctcttaggggatttggcattttttctatatccagattttattagactgtctagaattgtttttcattcattgtgttggtatgcattaattttttcaacatgaaggctcattcataacattggagtattccaacgtaacgttattcgttactccattcctgtgttttctctggaattagtcccgtgctgaatatcttaaatccattctccatgttcgttaagcatatatcttctattttttattttatctaagttttggaatatttctatgacttcaacctctcactacactttttaaaaataagttctccaatcatatcttttataaccatcaactctttttcaaggtgacatatagtattcttgttttatgtatatcatattttctttatgatcctaattaagatgtttaaaaaggtccctctgttccatgaatcatactttcttcctcttgcatcatttatttatgtgttcattttggatcttctgttttgtgcagtttacttcaaatgtctggtgaaccttgattgcctacttacacgaatgaaagactagattgacttgtatacttaactgtatacaagtgtagtttattcagtactttaatagttttatttttgaacaagcttctgtcctgtacggaggactgactgtatcctctagagggggagcataggctgggagaaagtagcaaggctatcctcatcttgcaaaataaggttttattcagtgttgtcaatttctgccttaggaacccaagttttcccctagtaaactctgaaattttggagacagtagtcttctaggtttagccttggaaatcatgctttatatgaaggaggaatagggaagggaagaggagggcaaccaggacagctgttccagagttcttaattaatttacctgctgtctgtctactctgttctctgtaccagctcacccctagctagcctggaccctttccactaggcagagaatagcttctacttccatttcagacttttccagatcagggatgtaggctcaaggactccttctttatcaacacaattccctcctgtatgctgtcatctagaaatgccaaaattcactggggtgctaatagtccctctcgctacttttagtctattacaaacttattctttaattttaaaaattcatttaatcttcactgtcacttcaatgtggtttgagaataaggggatgctaaatatgtatgctcagtttgctatcttaaaaggctaagtttaaatgttgctaatgaagaggcttttttagcactttgaaaacaacctcttatcactatcactatctcttggcttagatacagctctctagggagggtggcagcccccaaaataaaatcatttcttctgactgcgcagtcaaattacagaagagtatattccctaagagagcaataatcttggtcccagagtttgttcaggaaagcctcaggagaagtaattcttttttaaaaatttagcatccaccagaaataaatctttcttcaacatatattcatttgagacactagaccagagtactatcagcacgtcatagacaccgaaagagaaaaagagaagttaaacacagttgagtttcttccttctctagtaatgtctttatccattttttcatgccagaaattaaccatgatccataatttctttcaaaaggtcttagaaaaaaacatagcagatcaataataaagctctaaggatgtttttttaccatttttttctattaaaaatgtcaagagtaattgataagaatctctatacaaccttttggttttctctttaaaaagaagtgggatcaggaaaagtaactaatgggtacgaggcttaataccagggtgatgaaataatctgtacaacaaacccccaagacacgtttacctatataacaaacctgcacatgtacccctgaacttaaaattaaaaaaatgggggatttactcaatcattgactctgaaacagttttgtacatattccagatgtgaagtaagcaatccagtaaataatatttaagctagtataaagaatcaatataaagaggttggggaccatggtgtaattgaaaaatttacttttttcaattaaaaatatgtatgtatgtatgtatttgcctatggatgtaatgtatacatagtttctgacattattatctcattctgcatagtcaacataacttataaaatgataaagtctggttctatgttttctcaaaatcaatttcttggaccatttccatttgcccacataaaataactctgttcctaacagtgttaaagctaccattctgtgtcacctttgtatgtaagaagcctgtggagagaatgatacaaaagaagaagatttttaatctctctaaattcttgttggtaaatttgcttttcccttttaattacttcttgtagagatgtagtatgaattaaaaaaataacgtaacgctaaatgtagaatttactaaatgcataaatatttggaagaaagaaaataaaacacaacttcagcattagaatactgcctatttgggtgccaatcgaaggagatttttctgaaattttctagacaatgataaccggaatctattacagaacaaagaagtgttgctataacaaagcagcatgctgcatataattaaagcattaaaatagcatacagacaaaacaggcacaacaagttttgttatatatgaggaaagattctttaaaaattgtaaaaccagatgtgccaaatgactgaaagtaaaaataacttgacatctgactggtttataaatccatcaattatattggatagagttaagtaatattttggcattttcactttgttacctttattcagcaattcacaaaaatgggtaaccttaagggtcttaccaatttacctcttagctctgaaagtgaatactgctcagatattttaaagaatggtatctgcactgaaggaaattaaagtaaatactgagaaaataatttatccaattcccactagcaatacacacacaaattcagctgcattcctacatatctaaatatgtcagctttttctcagagacatgccctgaattatcctacaaaatagaatacatcaaagatgaaagagcattcagaacatcagcacagaaatacatcgatttctaaaacataattttaaagtgcttccagcatatacaagatacattcatattcctcagttgtgtagtgcctagtactaccttattataaagtaagctttgcatctatttactacttatccctcaattacatggtaaaattggatagttaaaaatagaagaacacataaatatagaaatcattggctttatgtctggaaacctttatcctaagatgtttagaaatacgcttacttaaaaaacaaaacctgtatttgtgataagttctcttaattttggtaatggggtgtttaacttctaaaacctgaggttaagaaattaaattctgtcatttcatgttttggtgttgcagttccattctcggcataagggatattgatctaataatcatactctactcctccaaatatctagtcattttatgtccccacaaactcatttattataaaacccataaaactattccctgtggtgcctataacaaaggaacaaactgaacaataaaaaggaacaatgtacatttttattatgttttaacgatatccccattgccagtacatacacaaccaagtggaaacgttttagccactggcatttccagagatccactttttgccactctgcaatacaaattcacgggtgaaaacatccattaacagaaaagttaaaaggcaatatctatctattataaataaacagtacatttatgagttaatccatcttaggtcactacatgaaagccaggcacagtcattgttacaggtatttctcttcctgctgcataaaattctgattgaaattttatcgtgtttcaaaaatcatacgtagaccaagtgtgtaggtagaaaatggtgtctttaaattagctagaatcagaaaatatgatttatataaatgtaataaaactcatttattggttactcttataagttcaagcttacctgaccccatatattgttaagtatatttttttcattcaacaaatacacattctagtcctttctagccatagtctcaaaacacttgatcatatatcccagtagtaaaattttaactgtggcacacactttcaataaatatatacttaagaatttataaattatatacaataattaacaaatgaataattatgttcataataaactgtatataggaaacataaattttaaaataatgagatatggttacaataaacatttttaaagcatgttcccaattgcaatggcttcatgttatcattaactaatacctaaaagcataaaacacagtattccctctgggttagtttatcaacaataatggtggacgtaaacacatattatagatcatgttgataatttcaactttgggatccaatctcttgttacatataattactttggcactgctttatctcataatattttgtatttagttcataatagaataaatgctagctattttctcaccgcttgtgttgttggcattttcttcattctgacatttctctgcagatttcttttcaggccaattgtggatttggttagaattaatttaatagataacataatagtcacattgtgataaaagggttctgctttgtagaactactactccttcttcagaacctttgtactggtttttttgacagacaactccagtgaggtgcctctgtcaatacatgaggtaaactgcaatgcacttaatacatgtacttgttaacaataaataaacatacaagcaagttatcttattttctttccacttctcaggggattatctcttgaacttttctggggtgtatacatcacaacatggaaacaactactctataagtagtgtctaggaagatgaatctggggatttaaaatataacctatttgtttttaagcataaaaccatgttcaactatttataactcctagagaataatgaatggttgatagaacttgatttttcttattttaatactttattttattttattgctggaatattaacgacattaaaacatgaattttgtgttttattttttgctacattccctcttccagaacagtgcctgacaaacagcagctgcacgtgaagcagtttttaaatgaatcaaagcttattcagctgcaggtaatggttctttccattgctcccagttattcccagtttacccagcactttccaacatcctctccacagtcctgagaggtgtcattttcattttcttcttttttttcttttcttttctttcctttcctttcctttcctttcctttcctttcctttcctttcctttcctttcctttcctttcctttcctttccctttccttttcctttccttttcctttcctttcttttcttttctttcaatagttttggggaaaccaatggttttggttacatggataagttctttagtggtgatttctgagatttggtgcacccatcactgcatggtgtacagtacccattatgtagtcttttgtccctcactccccacccttcttcacaagcccctatggttcattatatcattcttaagcttttgtgtcctcacagcttagctcccacttacaaatgagaacatacaatagttggttttccattcctgagtttctacacttagaataatggtctctaataccatccaggctgttgtgaatgccatgactttgttccttttttatgtctgagtagtattccatggtgtgtatataccacattttctttatctactcattgattgataggtgttaaatagataaactgttcccaacataaagaaggaaaaaaatatattcctttgactagcttcaagacgaatgcctttttaaaacctgggtttgttatgactaatgcttaactcgggtctagttatctggacaaataataagattacaggacaactgtaagataaagattcaccccaaccaaagaatgagcactggggtttctcattaaaaaaagagcttcacagtctataatatttcaaacaaaacaaaagcatcctttacctaatactagatatttgtttctacctgatcctgaatcaaatcttgaggaagctgccattgtttttctgattatttctaggtaataaaaatgccctaagcttacttttagctactagacaatcgcctgtaccttccttactaaaataagtctagttttgtagcatctaaaaattcatagtgatatccaagttggaactcctcattcccagcttaggcctacctgggaaaattgcagtggagaagtgggacctcacctaaaattcacagtctgggtcacaatggaaactctcttatgggtctaaatcattaaaagttatcataaggctaataaattatttaaaacatttgtcacctatctttctaacaatgtggaagactaggttggaatttagaactctaaatttagaactaggttggaatttagaatttagaattgaggaccataagagaaacagctttcaacccactcttctctacagatatccaagcccaagcacctgatcactgtctttcccaagcagtaatcagatattccatggcatgtcactgatcccaggtgtgtgcccactagtgacacagtgacacatgggaggacagatatggagaaggggctcacatggggcctagaagtatgctgggtaccatttgggcagaccattctgggttctggattatcttcagcatggtctagaaaggggaataagtctccaggtgggcatgttcccttgtacccatggatgtcttgctccatagagaggagtggttccagaagaaagccagagcaagatctccaatgtgagatccaggacaaggggtccctcctggcagtgtctaaggaaggaactgggaagtgagttaaggcgatattctcttctctcattccaccttatcctccattctctagtttcttttgacatcttcagtaccaaagtggatgagatgaaatccttgatggtcaggttgaaacatggctttggtgatctggatttggcagatgtgctttgtgggctctttttttcctgggacaatggaaggttctgtgatgacatttcatcactgggaattctttacctctagctgccttcttttatgggcctttatgctctgtgccctggatccccttggagcaccatgttgattgcacagggaccttctctggattttcctcttgggctcccaagataacagagcttcttggttttgagaagtccacatctggcccacaggaaatccacacatattctttccctgccatattctagaactgtactccattccccatacctttctctgtccttgatctgtatccagtgaggacagcttaggccatagccccttgtctttgggcctcccaagaaaggcactgaagcagcagtccatatgtaactgattatatgacatcatcataataaaaggaaaagcttagtgttttatttctttctgaccttcccacagtccttttcttcctttttcagtaataacatacttaatatcaatcatatttttaaaagtaaatatttagggaaaacagacagtgggcttttaaatcgaccaagactcttgagctttgtatttgagaaagctttaaaaataaaagttgggcaagaaatttgaacctcaaagagtgactctacttttagatgacaaacccaaatcatgtttaaagtccctgaaaaacagaaaatgaccaggaagttcattttaaatatactctctaaaccatttgagaattgcaggccataaactatggcagaaagatagctggcaataaatttttcctcaatttggttgctctgaagaggaaagagaaagactatgttctcagacaaaaatgtcacttacattcctatgagactataccttaaagagaaactgaaatacgttatattcctatgagtttaaaatatcaattaaaaaataaagctcactaagaattaagttactttaaggaaataaggtaatttcatgtttatttactttttaacatataagaccatcaatgcaaaaatacactaaatatcttggatgactttattaataaaaaagtcatggatagctcagaaattcatctaatcaaacttaaaagactaatcagtgcaacttaagatcaaaatcagccatgctaggtcaatctatctacgtaacttagaataatgttagtagtaaggtattaacatggacattgtgacatcttttatagacagaaaaatgcataaggaaagttttagcaaaacaaaacaaaacacatgtataaacttgcagtttaattcatcttaaatgaagatactgagaatgattatccatactagaaaatgctatccattttcatcaaaatactatcctgtcatcaaaagtatgatgtcatcaaattctaccttataaacttctaaacggattccattgctttactgtatttaaatatggtgaatcatttatactaatacatagctctttagaagcttgtaataattgactgcttttaagaaggccaacttagacctctgaagctggccataagggactactgctgtatatgctgtgctatgattttctcatcatatatgcagatacaactgagagggatctgaaaaaatattttttttaatatatgccctgctttttccacaaatcagttaaaacggtttgcagtaaaatccctacatatgaagagacgtagatataaaaataaaaataggtatcctaaatgattgggaagaataggaacgtagactaggatacttactggatttgaacattaagtttgtctatgtagataaaatagcttttatagttctcattacttgatgacatgggtatcttcatacttcagaaattataaatatgtgcttccttgaatttaaataaaatatatttaaaaatatactggtaaaatatgccagcactaattcattcaataaatatttatagtacagctaccatgtgacaggcacccttgaaagatataagagaaatatccgtatgtaaaatagccatatatccctgccaagtagtggtaaataaccccaactggtcaagttcaaaagacaagataattgcaatgatctctgttgcaattcaccgtggtgttctctagcgttctgctttggtagtcaaaccataaacaagtgtttagtgtgctcttatcactcacttatttataaattcatttacccaatatattttgagtacctactacatgcaaatcacaattctaggttttgatcaggaatcatagatgactcaggcagaaattatctttaagctgcctggagtgaggagaaatatataaataaatacaaaacaagggagaaagaatgaagaagtaagtgtcttacaaggttgaaagcagagggactttcctgcctgaggaagtagaaatcctaggagcgtttttggaggatctgggcctggcattatcgatgagcgataagggcaagggctttccaggcacagaaagaaaatcagcaagggcaggacaatgggaaattaaggatcctgaaggacggatggcaagtggctaactttagagaaccatttgtatgtaaaggggaatatgaaaataaattaaggaagttagatcagggtcagatttttggcaagagaataggttcagattgtgaagctggtgtccctaactgtgcttcttgctattaaaatgtaaataaagcatacagctagactctggtccttaggaactttataatctaatatgtacatggccggacaaatgcaagatcctcacattgaattgttcccatattcctttcttttaccagatgatgtttagagttctataagaaaagaaactacacacctgacacagttcaggaaaggtcacatatttagagccatctcatctacgacaaaaccatcttctacctgtgttttaccttttacttgtgactaccgtttctcaaggcatcatttctcacaacggcaactcttgtgctgcattcctcttctaagtgctgctagctcctgccttccaatattgctcttgaaggattcactgcctaggctgtgagaatgtagcattaaggcatacacaactgggaaatagtagctgacaatggactaaaggtatgagaagcaaagtgactccaacaaaaacagtgtgctcactgtaaacaacaaataatgacaaaacctccagcagcaagagaggcaaatggctctctcgataatcttgatggaaagcactgttcacggctccttcatcttttagacaaaggatggcaccacgtgcaaggtaacattaacataatcactatttgtggggacaattctaagtgctgaataagtgcttgtagacagttatgcatgggtggctgttccttctactgtatatttgtattaaaacatgtatatgtgcaaatgcaacagaaccctgcattaaacttcaattccacccacccttgcctcctacatatttatcaatcatttaacaataaccctttcatcttttcttgcttctgcctcactttgtttccatctgccctctctcctttgcatactaaactctccattttgaaatttccatgccactgtcactcctctgtcttccaagtgattgatttaaacaatcttaaaaagctttaaaaattatctaacaattatttgtttagcaatctttatatactacatggctcctcatattcaccaaaaatctaataaacactgacaatctgacaatctccaaaaggaggagatgaggtaccgtgttcctcaacttatttggccatgggcctcttgttagaggaagtattatttttcttcacattaattttataagctcttaaagacacatactatttaagagtttttgtttgtttgtttgttctcccttgttgttctcccttgttttgtttgtttgtttgtctttttcaaagcccaatatcatgggagatagactgctattagacaatacattaaatgattcattggttaacacaccaaggctcattcattcatttgtttacttaacaaatatttatcaagcacctatgatgagctaggcactttttaggcacagcaaattacagcaaaatgtaaacaaatcaagtccttgctctagaaaagatgcttactctctaaagagaagaaaaatattaaaacataaatataaaatgtggcagatggtgatgagtgctaagaaaataaagatgagtaaaagagaggaacagcaaagagatggtggaggaagatgttaaagaatgctgttgtcttcgggttagttggaggaagccactctggaaaattcttacttgagctaagatctaagaagaaaaggaaagggagcaagaatcatggttatctagcaaagaggaggccaggtaaatgatcacaatgcaaaggccccagactggaagctggactgacacatctgaggtcagcagagaactgtgtggccaaagtagaatcagcaaggtggagtatagttggatataagatcaagagagacgaacaggaacggggcatgccaggttatttttgttcactataaagactttagattctgcttgaagtgaactatgaaaccatgggagattttaaacacagaaatgacttattactacgtatatttgaaggtatcggtctggattttttttgagaataaattgggagcaagtgtagagtcagcaaaatcattaggagcacgtcatagtgcataatgctgccttaggaagaagtgaaggtggtaagaggtgattaaaatctgaatgtgttcttaaactaatctcagagcatgcaggagacattgagtatagataactcttctaaggagtttgattggaaagtgtagaaccagaacaatagcgttcatgagtttgccccttcctttcctcagactcccacacctctcctctctctccccttcttttcctccttctctccctgcttctcacctcacatactgagaaggtgtacactctcaattataagatgttactttttaaattgaggcacctggtgtttcaatcctctctactgcctaatttagcacagataaaatcagtatctatttctgttttattttagtaccgatttcttttactatgatgaaagaataagtattctgaaaaccaataataccaagaatgatagtttatcagcatacagaacatttaattgtacaaaacactatcacatatactaaattgacagggcatcaccaagtgggatctgagaataggcaagtggcccagttatttctattctaaaaccaaggaaaccaagacctgttattatcattacttaaagttgatatgacttgttaagagtatagaaggaatggaagtttaagtcttttctacatttaaattctcagctctttcaacaaccatgctgtcattatccaaataaactgcactcattttatttagaaaaagtcagaaacaattcctttacttatcaaccaaaaaagcattttcagatcaaggagagaataattctcatttggaaatatttcaatttaagatatatcatataaaatgattaaaatctcctgaatatctaagtctgcttatttccaaacgatgcattgccttaaatttctctaaacttctaggctatggcataattgcaaaataaattaaaatgttgagagcaaaatcaatcattctaaaggctgacattagtaaatatccactctatgcaactgtgatttccagatttcctattcaaatgtaaatgatgttctattttttaaaatcattgttgtattttagcatgtaattattagtcttgatttacatacttctgttatgttttctttaaaatatactgcattacactatcatgacacataacacacaatatatctaaagacaaccaattttatgggtcttttaaaaatatcaaaaattaaaaattcaacatcctaaatagcattgaatatatttaagaccttccttgtacctgtacatacctatatatgtatgaacatatacattatttctctttaaatttctagattctatcttaatgatgctgttgaaagatagaaagagtggcaatcacaatgcatacttgaaatcataagaacagtatattacgctgcccacatctatagtaaaaagtgaggtaaaaagagaaataattataatgctactgaaattaacaaaaatatcccataaatatttatgatgctggtcgtaattgacttcaaactatttttcatatacgaacattgttcaactcctcccaagtgttcattactaccttggtccaagccaccatcacctcccaggtggttgcaaggttccacgcttacccccacctgaacctattctttgccatctgccagaatcattctccaaatagaaattagttcatttactcccttgctgtccaccttccaaaagtgtgcttccacaattacaattacacaactacaataaaactaaaagtcctctctatggcttacacgtccttgactattgctcaggtcctctttctgcccactctcttaatcactcaccatgctccagacacatacccatcttaggattcaatacttgctaatccttgtgattcacatacttgaccccctgacttcattcacatctctgcttgttacttggtaggagcaagcttctttggctaagctctaaaacagcactcacgcccctttgttccataatctccattcttacaaaacataacaaaacttgttattatgcattgtggtgctgttatttctgattgaaattttagttgagataattatagattcatatccatttgaaaaactataatacaaagaaataccatatatattttaatcagttatcctcaatggttaacattttacaaactacagtataaaaacagaaccaaaatattgacattactatgatagtccaatcttattcagatttctccagttttacttatattgatatgtgtatgtaattaggctctatagaattttatcacatatgtaggtttctgtatgtgtcatcacagtcaatatacgaaatggttcaaacacaaggacacctcatgttgcccttttataaccacactcacttccctctgtccctaacatctggaaaccactaatctatcctccatttctaaaactttgtcatttcaaaaatgtaattaaatgggtcatctagtatgtattctcttgggattggcttttttttttcactcagcttaatttcctggagatttatctaagttgttgtatgtatcaataggtccttcctttgcattgctgagtagcaattccatggtatgtatgtaccacagtttgtttaaccatttgcctgttgaaggacatctgtgcaattctagatttcaggcattacaaataaagctgctatgagtatccaggtacaggtatttgtgtgaactttaactttttacttatctgggataaatgcccaagagtgtaattgctggactgtatggtaatgcctgtgtcacattttcatcatctttttctccattaatgaagttctatgacagcagagacttggttattttggttcagtgctatattccactatccagattagtgctttgcactgagtagggagttaataatatatttgttgtataagtgagcttcagatcctcatgaaaatttattctcttgtttatagctgcctttacaggagaaatgatattgcaaaatggtttcttgggaaagacagtagagaggagaataagagaggtgtggccatagcatctgtctccaaatagcctgagatatctgaaccctgaatgaaagagaagttaaggaagaaaggctgagcaacggtgttcacaaaaagatttgtaaggttctgggaaaagacacatgtctttccaactcccaagaacatagtaagacccaatgccattaaaacggctaggcttgaccttgaccttagaccatgtgcagtttcagttggctaggtgaccattagcagagaacggagtagtcttcccttatcactatgttcaaggtcagaacaacagcagtggtattctgaaaaatagtaagtaagctctcattaaatatttatcaaatggataaataaataagttatttcctcacatggctggggaagactttaggggagaatgaaatcctacctaagcaacttacttggaagatgataactaagagcaacagtaatttagaaatcagtatcacctttggctacaaggcctaggaaatttgaattacatgcaattttttaaaaactgcatttgtaatactatttctatttctgggaacaatctttataaaattatgaatcggttctattttattttattttaattaattaatttatttatttacagacagagtcttgttttgttgcccgggctggagtgcaggggtgtgatctcggctcactgcaacctccacctcccgggttcaagcaattctcctgcctcagcctccagagtagatgggattacaggtgcccactaccatggctggttaatttttgtattttgaggagagatggagtttcaccatgttggccagtctggtctcgaactcctggcctcaggtgacctgtctgcctcagcctcccaaagtgctgggattatagctgtgagccaccgcacctggctgaatcagttctagaagttcaggcctattaatataaatatactaccttcatgagtataatcttctggcaaaatgcatctaacatttttgttcagagattattgtttttctggcaatcatattaaaaaaataaagaatagaaaagaaaaaaatgttttactgttaatctaaagtagcaattttcaactattttggactttatacatatctgagtatcacaaaaatcacaaactttgtgtctatattggaatagtgtctttgtgcaaatagctattatatatgtctgccatgacagtggtctttgttggtttccagccaaaggagaaaaacaagaaaataaaaatgccttggaactctggctcctatagataggttatgggctaaaagttgttgcagggggtggatccgattaagtgagggtcagattttaagagcagtaagctaatatatttttctgccctgattcttttaatcattttggggttcttgttataagacaatttccattatcgtaaacaaagtttgaattcaataaggttgtgcgattacacattcagtgtgggattataataacctatcccaagcttggtttctctttgactatttctgtgcttagtttctttaaggcattataacccttcacatatggttctagaacactgattttcagtcttagttgtacattagaattatctggggaggttttgaaactcctaatgcctatgccatactccagataaattaagtcagaatctctggggtgagagccaggcattggtattttttataatgccccaggtgactctaatgtgtagccaagattgaaaaccagagttccagacccatttgcatcactttcattggggtccttattaaataatcagacatggctccaaaactattaacttcaaatctctatggattggcaagaggaatctgtatacttatctggaccccacatgattcatatgcacagcaagtgtgagatcccttagtttacagagttaaggtgtctcacactgaccggcaaagccattggaaagcaggaaaatttctcgattctagtctgaaaatcttctagggttggagacaagtccattttggaagtttctttggaggtctttatttcaccaatatttttatatagtttgcaagtgtcagtaataacttcaggtaaaaatttacgcagtttttgaagtgaattcttggcctggcatggtcattcatacctgtaatcccagcatgttgggaggccaaggtgggggaattgcttgagcccaggatctcaagaccagcctgagcaacatgacgaaactctgactatataaaaaatacaaaaattagctcagcatggtggcatgcctatggtcccagctacttgggaggctgaggtgggaagatcatttgagcccaggagatgaaggttgcagtgagccaggattgcacaccactgcactccagactgggtgacagagtgagaccttgtctcaaaaaaacaaaacaacaacaacaacaacaaaaaaataaaaataaaagaaaaagaggaaagaatgaggtgaattctttattagggaatattggttttctagtggaaaagtatactgtacaaccaccagtactgtacaccaggtatttggtagatacacctgatagcaataacttaagcataccctgagaatgactctgcatggcacatgcacccaacaacaatgataagctaagtagaggttgccaggtagagggcattaagtgaaaaacgctatattaactgcatgctttctgcaggcagtggtggctctcctgtccagcctactgccactgggcagctctgtatgtaattcccccttgataaaccctgtctcctttgctggctctgggtctgctcttcagcctctcaaacctagtgccatccctactgaagtaaacagaggtccagcatgacaacaggaggtcagagaaaactccatgagtgcccagaagataggatctgagaaggagaaatctgcgagataaatcctaggctggccatgcatgtctgtgtggggcctggtagctgttatacttgatggatggggcccaccacatgagtatggaggtgccttgaaaacactgagtggtctggaagagttgttgcagggggtggatctgactgagtgagggtcagatgcctgagctgtgggagccacagttggtgggcggcttctgaccctgctccaagcagccatagaggctgagctcatggtgcaagtgagggtctgccagttgcaggacgagctgtgactacaaagaggtgccagacaaaatggagaccctggcttttcaggtagcctgtatgaagagtcaccaactcccctgcacccactggaagcagactcgcacgactgcccccctctcccgccccctggaagacagcagcgcaccacaatatgggacgaccccactgtagaattggtggagctaaaaacaggttaggacagaagggtagagagtcaatcatggggtggcttctccatctgtggaacatgcaggcagaggctattatactctccagacttgagatgagtaaaatggcaaaatggcatccatcacaaaccacccggcctggaagcagcacctctgtggtgccagtaatggagacggggccatccccctcctcagctgggtgagtgttgctgcaagatagccaggccaagtgagggagatgtccccacgtggcctttgtgatgacagactatggagggattgcagggcactcctccgggaattaggagtgaagcatgctatctatgctgagcattgccaaggtcccagcaatgaacttttcttgctggcatgaaagacgccatctaagagtccctgccaaaccaaaggtatggtgcactcgtctgtgcgtggggttgtgagggggtggtggtgcactgctgggatgaaagacaaaggagccaaaggaaaggagacagatgaggggcccatcagggtggcctgctgaagacatggcatggcatgctagcaggaatgcctactgtgagggtggagacaacctgatgctgtcttggtcaggctatggcagaagctcaagccagaacaaagtttcattaaagagcctcaggctcagttcactgcctctcctgcagagagatggcaagggcaggcacttttagacctggatgaaggccaaggcttcaaaattctgatgggagcaatggtggccagggtgtctgaggacagaggccatatgtagaactaactatatattggacaaataagaataggctgtgcttgccctagtggatactagagtggaatacactctcatatatggtaacattcatcagttcaaagggcctataacaacaatagatggttatggaatggagggggtacctattttccattgcattaatgatatgctggtttctaagtctttttccagcctggaggctgcagcccccaccttgttgtcccactaggcaaatggaggatggatggttgatgcagagagggtccaaggttcaagcgttttggtcaggtgcttgggtgtcatctggttagatgttaggcagagaacctcttcactgactgggcgcagactgtggcctctctctagaacaagacggactgttgggtctatggagagctgctgctttccaccatgggcctgccgtggcatgtacaggatcaactcccaagtgcttggaagaacaatctttgcagagtgattgttatttgttttttgttgtagtttttagtgctgctgccacatctggcagcaatgctcctctgcatacctggccctggggaaatcacggaagaatgatacgataaaaatgttagggccattcaaggagattctgagctgaggtgtatggtaaatccacctgatagcaataacgtcttaagctaggtggagactgccaggtggagggtgttaagtgaaaatgctatttaaactgcatgctttctgtaggcggtggcagttctgtccagcccgctgctactggaccacactgtatgtaacctccacttcaataaaccccatgtctcattgcctggttctgggtctctttggcctctcgaaccttgtgccatccccactgacattaatagcaatccaacacaacaaaaagctaaaagaagccatcaagttaaaattataaagagtaacttaaagtaagaattaatgataagaggaattctagaaaagtatggagctacatagtgagccttagcctccccctgccttactacacaaaatgtttcctaaaaaattataattgtttttaaaggaagggaaaaaaataaagacccatagcaatccccattatattttaaagtattagtccattaggcatacctaactttttaaagtttgtaaagtatgtcctgaaacgcctcatctgatcttaacacacatctgtttagagaagcaggacaaaggattgttaatcacagtttttaaagaagtgttatttccacactcaacagtgtcaaggtctcagtgcttgttgaagtgaactgaattactggatgagaaaccttaggcacagatccattaaatgccgaatgacgcttcatcaacttaccaagatagagttgtatcagaaactcaggtccaaccagaattcctcccctcacagcatggttcctccagtatcatttggtgattgaaggtagtggtcattccttaagtcagtaatcctcaagtttggtgtactgaaggatcatatggatgtttttaactaaattcaggctaccaagcaaaaattctgattcaacagggctgaagtggggccagtaatctacatgtttaacaagtgtaacatagaagacaaagcacgtaattgccaaatatgtgattaatgcaattaagaatgatcatgaaaacagcaaatatcattgactaactttgagaaaagtgaaatatggaagttacaaaagtgattcatgaccccaataaatattggttaaatgtaggactgcattaatcactaatatacaattaagaccaaactgacttaaagtagttagaatatacaaagagggaagtttttgattgtttttttctggccaactttctcagtggtaaaaaatatatatatatatataatatatatatatatatatatatatatataatatattgtatgtataatatattgtatatatattatatatattgtataaaatatattatatataaaatatatttccatatatatataatatatatatattagggagccttttatcttgagctaatgtgataacatgggccacttctcctaaactgtcctgtttctttccaggctcagtgggctcccagatcagccctcttttcttgaaaagtaggaaagaagaaaatgtgctcttaaaaggaatcaaaggctctggagctgtgcacaggtagagaagaatgtacagaatgccttctgtgggaagatgggaaggagttctgggagtgaagaaataacctttctctatggcattacatttgttaccaggcaatacataaaatacaattactctagccagtcccaaatgcagctgtcagcacaaaactgcttgcttaaaaatgcttttcaaaagtttgacctgtagacaattttggtgctcaattcattctataatttacacacacagaggtgtgtgtatgtgtgtatatatgtgtgtgtgtgtgtgcctgtgtgtgagcgcatgcgtgtgtttcacattcttctatgatatatatatatataaaatttgataattctataccaaatccaatactaatcattattcttataaagttataacctcatgctactttcattaccataaaaaggacatctaatagctgaaatccaaaacacaacgagtgctggtaaggatgtagaacacagggactctcatgcattgctgctaaggatacaaaacagccatgttggagaccttttgaagcttcttttacaaaactgaatgtacttttaccataagatctagaaattgcactactaggtatttgcccaaatgagctgaaaacttatgtccacacaaaaacctgccatgaatgtctatagcagctttatttataattgcccaaaactagaggcaaccaagatactcttcaaatgccaaatttataaacaaactatggtacatccataaaatggattattactcagaggtaaaagtaaataaactattaagtcctaaaaacacacggaggaaccttaaatacattgataagtgaaaaaaaatcagtcttaaaaggctacatactatgtgatttcaattacatgacattctggaaaaggaaaaactacagagacagtaaaaagatccgtggcaaaggttgagagaagtaggaaaggataaataggtgtacaggggatttttagtttagcgaatctgttctatatgatactgtgacagtacatacatgatattatacatttttcaaatcccacagaactatacaatacaaagagtgaactctaaactacggactttggtaataaggtaacagtattggttcatcaattataacaaatgtatcacagcaatgagatatgttaataagagaaattatgtaggaggagggatatatgggactctgtactttctgcttgattttttggtaaacctaaaactgctgtaaaaattaagtctattaatgataaaaccccaaaaacattttaaaaagcatatggaggtaataatgccgatgctggaaataatttttccaatttgtcacatattgataaaatagttgttaaaatagacctattaactatatatttgtcactcctgtatcatgaaatttaaagttctttaaatgtctagctattttccaaaagacatttagttaacattctgtcatataggacaaaatttaaaagtcccccaatatagctgtctgaaaaattgtttaattttctttttccaaatgaaatgttcacgccatatttgtacaactctcatttttattgattttcagtatagttttgattttcacaaaccttaaatattttgcctatatttattattatgtaactgaacgtgatagttgctaagctatgaaattatcacttttggctattcaaagccttatgtagtatttctcaaatttcagtgtatatgagagtcaactgggaattattttaaaatacagattctgattcagttgatttcaggtgatgcctgtttatctgcatttctaataaacttcctgaagatcctgatgcacgagcacatttgagtagcaaggttctaaatatctaggtcataaaactattaccaccatgaaaaacaaacccagatacctagcaatccttgcaagagtttaaagagctctttttctgtttttcctagctgaagaagcttccagggcccctagcacttctatagctgctttctcaatatatcacccttttcaatttcatctataaagaggacagcttgctaacctttgtacagtgagtaagctatccatttattcataatactcatggcttatatgaaccaaagaccatctatttccagttcaattatccaatttgtacgtctaaaaatcacagagagatcaaatgactgactcagggtcacttatttaataactgtaaaggtcaggtctcaaatctgggtttctgcttccaaatccagtcctttttcctctgttttctgttgcttctaataatgcaatgcagaaaatagggactaggtggtttagacaacaaaatccaagttcccactgcaattcccactgcaattcctaacatgggtttaaaatcttgttgtgggggtggtcagatgtattaaggggaaagatttctttgtgctttgaaatgtcttgaaattcaacaaaattatattaatttataagcttgtctgaatatagtatgaagctatattttatatattgtttgaacagagtatgaagctatagtttgaatatagtatttataagcttgtttgaatatagtatgaagctatgagagaaaagacttggggtggccagtctgtttccctctgggcactgcctctgatgccacatcacagggtaagtaagggtaagtaacatggtcttcatgggattaagtgaacatcaaggctcctgagattctgggctcctatctttatctttccagggctgttttgaagtgtccatgtgtgaaggctgagcagtgatgctagctagcatcagggagacctagccttggcacctctgggcccaacctgagaaaaatcaatagcttttcattgctttgttggtgatctgagcttttagggacaattccaagtagtttagatgcccgttgtacaaagcacacacgcccatgcactacaataggtttctacggaaattctacaaacttctggccatggcatgtctccagaaaagtacaagatgctcccaaagtcacagagcctgaaggcactctgttttttgctggtgcttggatacagctctcgctgacaaatccagctttgccttatcgttcttaataccattgtcttacccatcaatacagtaatcatggcttgcctattccttccccactcttcctactatgtgtcattcccctgtctctgatcaacattctgtccctccttcaagactcagcttgcatgtggcaacctctgtgagaatctccctgacagcttagagttggctgtggcccctctgcttgctgaacacctacagtgctaaggcaccacaccattcctttgacatttatgttcacccctccttctaagaagaaatcatcactagtgggatctactttctttaaccttccaagataaataagaattgggatttaaaaaagaagtgcaggtagcatacttattgagctttcaaagattttcacactaaaaatgccaacatgtaagaaggagaaaactggcttaagggcagggtggcagttttgtgttttgtttttttttttctgggtatcatctctgaacctaatcaccagagtaatttttggaaaacttaaaggatgtggctttaggacaaatatgaaagagacagatatcagtttaatgtaaagtgcatcttttggcaaggatagtggggcaataataaaaagggatgaccagaagactacaaacttcccatgccactgggaggattgaaacacagtctaggagtcctccactgtggacatggtgtattccatgggagagaagcagcattagccaaagccagggctctcttctgctctcagattctatgattctactacaaacaagaatgatgatggcttgtatactttgtaatcaataataataaaagtacaatgactatgaataacttactgtgctgacagtgaatcccattaaatcctcggggacatttacaaacatagcctatgaatgtatcccctcggtatgcttcacttatttcacaggttcctccattatggcatggattaggagtgcagggacctgaaagacagaaaaaaatatttctgcttgatgcatattcttaaaagtagacattaggtcaacattttgcaattaataattttacagaaaaaagtgttctagatattagtggcatagtaaatgtactggttgtatgagctctggagactaatggcctgggtttgaatcttggtttcaccacttcacaggcgtgcagtcttgagagatttacttaccttctccatgcctgtttccttttctgttaaatgtcaatactaaaaaatttgccttaagaggttataatacagatgaaaagagttcatacatataaaatacccagaacagtgtctgtcacatgtaaagtactcaaaaaattattagcattaaattagatattattaaaatttctgaattgtagaataccttctgggtgtttaaaaagtaatattgaatagcaatttctggagttgtattcacaactccacaatttttgtcccctgctggtacaagcagcatatggctgtaaccacataaaccaagtgaattggatagctggctgcaaagcttttatagagtatgagtttatggtggagcatacctctggggaagcacattttctgccaatctaaaacgagcagtccgtcaaaagttgcatacttagagaagaggggctgatggtcatttttaaacttgagaaagtaacagcagattatttagtacctgtggctgctaatgaaagtgtggtgctgctcagagctctcttggagaaaaccagctgccaggagtgtggttagctgacaacattcagctactgaaccacaggatctgctgtggcagcatttattttaaggccaggctccccagccaaaaactaaataccaaaggggcatagagctagctgggccagtcgtgcctgacctgagacttctctaataaacattctgtactctgaggtgccccaatggtgtggctgagatttttcttaaaaccatagcagtttgagactttttctatgccatgttctctccttccttttctcccttcaaagtgacaggctatgtcacggtctgtaggctcatcctatctactcttgctctctctcccctttgtgcatcacagacattccccccaaaaatcttttacacttttaattctatcttacagtcttcttcctgcaggatgttaattgactcaggacagaatccagacttgagattgtgaagaagggaagagtcaagttgaaggaaggaaaagctctccctgggagatgaaaaaagacaaaaacaaaaaactacagttttctctaatttagtctgtactgattttaattggagagagtagaacatatttataaggaaaagaaaagccactgaagaggaagttaagatgtacatattagaaaaggaaagcaagggtaattaaactaagtatctgactgtgtatgaagaggtgattttgagagccctagaggatttgttcagaaaaggagtgagtgtgttcagctgaaacaagaagcaaggtagaagagctggacaaatgaataataataacttgagtcaactgggttggggcaagggtattgaacagagagtgctatagagaatgactcctcctgcatgggtcaaagccactaataaaaacaagagctgaacgaggtggtgcacgcctgtaatcccagcactttcagaggctgaggcgggcagattgcttgagcccaggagttcgagacaagcctgggcaacatggtgaaactccacttctacaaaaaatacacacacacacacacacacacacacacacacacacaaatccaggcatgctggtgtgcacctgtagtcccagctacttaggaggctgaggtgggagaattgcttgagcctaggaggttgaggctgcagtgagttaagatcacaccactgcatgccagcctgtgtgacagaatgagaccctgtctcaaaaaactaaactttaaaaaaaacaaacaaacaaacttgtgaataggaaaaaaaaaatcaccagcatcacttcaagcactgcaatcggacctcaaccatgggtgggaagcacttagaaggtgggcaactttgtcatgcactggggcaagattttatgaatctatttcttcttctgagagctgtatttgaccctccatttttttccatttaaaatgttatgaaattcaacggttgtggagtctaacaaagaaacacatggaacaggaaacaatgtggcaactgtacagttcccggaccttgacttcccgataggactgattttcaaaaagtaaaaaggattcaggggctctgtgattttttttttttgtcagcaccacaccaattaaaaacaatatatttatttaagtagacagttttgtgctgtgaagcacatatcaattaaattatctaacacctgccttcgaggtggtacattgccaatatttgagacaggaaagaaggtgaatgaccaatgactagttatagaacaatttgaaccattttctttcattgctacaaaatgaaaatcatgctgcagaacctatctctccttctcctctctctgtttccacttcctccctcctcacaaattaattaacatttgatagtgccttacaatttataaactcttttcacataaatcatctcatttattctttactataacttaggtcttcgtcattatcattctcttttacagtttttttttaaatactgaaggtcagaaagattatataatatttctcaatcaatatctaccagtgacagattgaggcctcagactaagaatctgggattctaaaacctatacccctcagagcatcaactaactggggaggggagaatgaaatgatagtgatgttagagttttgactcatcaattcacttcaaatgagagtaaaaatgatagattttgaaactaactgataactgacagccaagcacataaccgctaaagaaaaaaatatataaataattacagtcaaaaattatataattttaagcaaataagagtccttggagatcacttaatccaactttccagttttgcaggtgaggaaaaaaaccaaatacgaattcagaaatgttccctagaaacaacttaatatgagaaaaattaggtttaaggacttgttcctaggaggaaaaatagttatttaaaccaaaactggtaagaaattaccgaagagagtggagtaatttatatcacagagaaaataagtcttccatgctccttcacacttacagggttggacgagggaggaatagaaaatgactgaaacagtaagtcctctgcgagttcttgagagcagttaaaacagtgattctgggcaggtgcggtggctcacgcctgtaatcccagcatcttgggaggcagaggtgggtggataacctgaggtcaaggagttcaagacaagcctgaccaacatggtgaaaccccgtctctactaaaaatacaaaattagccgggtgtagtggcgcatggctataatcccagctacttcggaggctgaggcaggagaattgctttaacccgggagatggtggttgcagtgagccaagatcgtgccattgcactccagcctgggctccaagagcaaaactccatctcagaaacaacaacaacaaaacaacaacaacaaaaaacaacaagtgattccaaggaaggaggtaaatggaagtctctctgacaaaaatggggcaaataggaacctggaatctatgatgctatttactcaagcctactatgtctttgtaaaagtgaaacttggctagaaggtgagaagagcaagatgacctaaatggatctgcgaaataaagggaagagctggggaatggatgcagaaaactgagaagcagaaattctaaaaggaaaggcagaaatatagtcttcaaggagagacagaatccaagcaatgtgctcggaggctgtaatatgtgatgaaaagtagctagtaagaaattgtgatgtccaaaattcaggtttaagttgtttgcacagatgctatgtgaattgcttctgctggagcatctagctctataataacagctgctaaacacacaagcctgtgagtggtacttggggaaatcaaggggaaagggctatactattgatgtggcttatcctggcagaaggggaaaagtattgctgcatgtgatgcccaagagattcaagaatccaatgggttcaggaagctgaagatagagtgaacagcggtttcttaagtcccaagcattctggacacttcctgagggcacaggtgaagcctgtccagcaatcttggggcagcctctgggatttctagatgatgtgaattggtacattggagctcattttatttacacgccaaaagacatcatgaccttggctgacatctggattttagaaaaagattatgtgtttcagaggttatggctgctgttatttttcctactccaagaaattcagtgactttcatttaatggatgaggatggagtaaagcaaaagggccaaagattaaacctttctagagtcccttgcatgcatgctagacaatatgagtgtacatattatctttataatgccttgtaagactataatcttgttttagaggcaataaaatgggctcagggaggataagtatcatatccatctgaaaaagcatagattttaacacactctgcctaactataaagtctatgccctttccattaagccacatttcctaccatgttgaaaatctgtgtattcatgttagtcttcacagatgtaaacggaatcagcatgaattcactaagcacattcctataaataatacaggactccaaaatggaaacatttcagaatattttcaggaaatgggtcacagtgtattagatattaggaacagaggtaggctctgtaattataatgtgagactgatgttatgtgccttgtacagactttttttcaagtactcatgacagagtgttgaaatgaatggtttcctattgtttttccctactagaccataaattctgtgtgggaagacttaacgttggcacacagtaggtgtttgatacattttgaataaacaaggatatggcaataatgagttctaaaaattatatttgctgcctacactgtattctaattttaggtttatgacatcattttcttttggattttcactcaataattaagttagatattttctggaacctttctacacctttcaagcttctagtcctttaaatttataattagattccaatgtgttttgtctctaatatggtttaagcttcaaatgtattacactgaattgtaaataacagaccattagaatgtgtacttttgcataatgattacatgtatcttaattctttggcaaatacataatcaagaaaaatgtaacttgtataatctcattaactgtttgagttacttaatttaactacttctatataaataaaaacattcacttcatgtatgagcaagataaaatgatcagaatacaagttagtatataaagataacataataaatgtagtccaaggtctcaacttacaaaagttgcttcctagccaaaagttatgtttgatgctcaattgcaacagtttccagttttattgccccaagtgataataagcaggctattcatatgagaattagaaatcctggaaaagttttgactttgtggttacccccattccatagtcttctctattttgatactgaaaaaaaatattactaaagtaatatgtaaaggtcttgtaacactataagtaataataatcacctagagcatatagtgttgcttatactgggaggataagaaagaaatggacactgcccagtatgttacagaaggtgtttcccccactaatttcaggttaaataacatttattcattaagtactccttatgtgctggtctctgctagtaatttgggataagcactttgtatggtattaaaattgtcagcagctgaaagacaaatctcacatcagaaaaatatccttagttatccagtttgggtatctcattttttaaggtaatttcaatggctctcttttactgtgaatatactatgcttggtattaatacatttctttgttcatataatggttcctggaaatttaattctaggatttcctagtggcaacatattaaaacatgaaaattaagaatcggccatattcttaattttagcagccaaaactatagtacatttgaggcatctcatatagtttctataacataccagcacacacgcacacatacaagcacacatgtatatcactctcacacagctttgaagcagtttaatagcagatcaaagtttgagaacaaatgagtattattcaaccactcagagcttgtaaaacaaaaagatagaagacaagggcaatctcaattgcttgtcacttcaaaagccttgtaaagaagtttgtctttctatgcattagggcatacagaagaagtatacagagtggtgactaggagcttgtgttctgattagtattcataaaattcgaaattatctgattagacaacaatggtaatatcactcttaacaatgaaagcataaatggactttcaagatacaagaggctttagggagttttaaaatcaataatgctgtaatacttttgcaggtaatctttaagtagctcctaacacaatggggacagcatatgatcaatattaatgaacaactgaattcaacagcatgctttccaggcattttttatgcaagctcatataagtatgtcaacaagattaattcctcacaaaagcagtagatctatatggtttgctacttttctgcatctatctcctcacaattccaatagtagagttagagttatttccatatgtgtaatatgattagctgcttacacacttagagactgtgcccgaaatcatgaataacttatagtacacaagcagattattagaaagtgaataggttaacattctcctgtgataatatgtactaggctttggtcaatttttaaaaaatatgcctccaaaacattgccagttagatatcaaaataaatgtacactttatgtagtaaggaaatgccagtaaggcaattgcaacagcatagtttttactagttgtttaccactagaataaaataggaatagctatgaccccaaatttcaccccaaattctggtgttaagaacatatcgaagttatcttcagtgttgcctttacatttaataattttttaacattttggcagttgccattttgagccactgtcactctattttaaaaccagttgtaaagaaagaaattattctgggaacgctcacatgattgacgtttgcaagctattttttaaacactagttgttgcttctcatcctgctctttttccttctcctttgtactcctcctcctttgtaaacgtaaatgtgcaaaattcagccatttgaggataaaaatcgtctatgagtattttgaatatgaagaaagacgtaaactattttatgatactatctcaaacatttcattgtagtggagaatcagtaaatttaatatatttttcattgaacaaaaaagcatttggatagattataaaaatggaaacctgaagatagagatttcccgcccccccttaaaacctgttgataaattttcttctcaagaattaatactagactatctttatatacgtctgtctataagaaggcactgagatgaccagtggagatgctttagaggtctttgtccttgtttacattcccaggctaatgtaaaaatatgccacaaacatggtagtttaaaacaatagaattttattccttcagagttctagaagctagaagtctgaaatcaaggtatcaacagagccagactccctttgaaggctccaggaaaaagtccttccttgcctattccagattctggtggctcctggcattccttggtttatagcagcaaaacacgaatccctgcctgtcttcacaggccttcttctaattgtttctctcctctgcttataagaactcaccataaatctaatacgtcttcatctttagatccttaacaatctttatgcacaaaggccctatgatgggctaaactgtgtccccccgagaacttatatgttgaagccctgatcttcaggacctcggaatgtgactatattcggagataggactttttaaaagagataattaaggttaaatgaggtcatataagtgggccttaatccaattggactggtgtccttataggaatagggcatttgaacacacaaaagagacaccagtgattctgccacacagaggaaaagccaagtgaagccacagcaagaaggcagctatttgtaagccagggagaaaggtctcagaagaaaccaaatctccagagcctccagaaccgtgagaaaacaaatttctgttgtttgatctacccagtctgtggtattttgtaatggaagccctagcaaactaataccctgtttacaaataaggttgtattcagggttcctggtatacctgaattgggggtagggagcactatttcacccgccttatggttcctgtgtagttgttttgttatagtattgcagttgattaagtaaaccagagttttatgtattagaatcggctggcaaagcactcatattatcagtaattaaaatcttagctaaaattaattttacttggttctcgtcacagagtagtggtggataagctttgatggtgctggagatcaggagagcagtctaaatttggggcagtaactaggtagaatccagaattgggtagccaggggacatcaaggagagcctagcactgcatgataggaggacacattaagaaaggaggaagatttcctggggttaatcttcatccacttaaactattgtttagagttgggcttgctgatggcagtagtttttcaggcactcagcaactttctgagaaagtctttatatattaattccacaatgacaggtaatcattgtggcacagtagttgatgtctccttttcttcaataaataaatatcttattaaatattaatatgactttaaagaaaattaataaccaatcacagcaaaagagctatcattttacaaagtgataactattgttacagctacactttgttaagaggcagtctcccatttctttcccccgtacattcatcttgcacactgctgcgaaaacaacctccttaaaccactacttgcataatggaaattctcagctcagaatgttttattactcaaagagaactctatatcaatactctgtagttattctgcatatacattttttatccttcaaaacatgctgtctaattttgggcatcttttagttggccaataatatttgctgactgtgtgatgttatggcttacataaaaatatgtaatgaacatatgacaaaaacaatgttgctgcttggttttctttcaaagactaagaaaactaaagctgacataatatacttaataataataaagctagtatacagaagccttttgtgaattagtgaataccatatgaaattaagttatcatttttgaatttagtaatataaggcctaggtgcaccttgaaatctttggccagtgggataaacatgaacacccctataatctaagagaaacatagatggcaaacctatgggctatgttgataatcaacatatttttatttttcctgatggccttcagaataacaacgatttccatgcaaaatttcttgtaaaaactttagaaaccataaatgtaatccaacataactcataaagcacacatcaaacaattttcctcaagctaagaaaattccttaaaaagtctttctttttagatcagggagctatttccaaacaaaatcctgcaaatcacttttttaagaagtatatctgtcagaactcacaagccattcattacacaatacaattaaagtttgagaatacacatcagcttgcagtgcaaagtcctaagatatcacccaggtttgccattagctaccatagtttgtttcattttctacatatcaattagacagggcataagttaaagacagagcagagaccagtatttctacatatatatatatatatgtgtgtgtgtgtgtgtgtgtgtgtgtgtatatatatatatatatatatatataataaacaaatatctgagcccaagtttcaggggcatcaagcaatctcactatttcacatagtgtctctaagcaactacaaaaattgcatgttcttcatcaatctttctctgacagcgcttcacctttttcaggctcctactcaacttgccacctatactgcatgattagcatctcacttttcattgcttcatcctctaattattccatagatctcttttgtctccctcactgaattataaattagttttgcataggaaccttcactccttatatttttgtaccctcatagtccctaatgaagagctaaatattttgatattgtttcataaatgtgtgatgattgacttaaaattattactaattttagaaatgtcagcatataacccaaactgcaaatcataatctataacagaaaccaaaaatttagagattggatataaatatcagtagccctttttcatttacactagcaggtttcaacaactcaatgttaagctgcagccaagcctaattctctttgttgaatgttgtagcaatctgtaaaatatcagattttggataattttataattataaacaaagtgtgttaaaaataagtatactatttccacaaagctacagttctttctcctataatatagcatagtgatttttgatcttgaaggcagtggcaggaggtggaggaaaggatttctatttttacttttggaatctgtcctccgtgactgccatgttaatcatgaagcagagagattcctgcaggagatgttcctgctgcactcatatgggaatggcacctacctagacttcacagctgagaacattggaagcacagctggacaggcaagttactgtttagattgcctcctcaggtctcacatgtggcttccttgtggcagatttgaggaggcataaaacaaagcaggcgtggattctggccagctggccatctgttccttcacctactgtgataatttggtcttgtagaattctgttaagtgagcattaagtaatgaccatgtcaaacagaacataatgactgcttataatcactggatgaaagcttaagggatgcttgcccaaacacagaaaaggtcaccaaagcaaaccaatattttttttaaaaaaaaggaacagcaaaattgacacaaaacagcaacagttaactttgttttcatttttactttttatcatattgaatccatgtcaaatcacagagggtgaatatggtacaaaggagctaagtaaatacactgaagtttctactgtctcattatgtgtatatcaatttacatagacaaactaaataagaattttaaaactaagaaaatatgtgaggggctttatcacactgaactaaatttaaggcacttagggttatagccattaacttcaagcttttcgaaatagtttcccagaacaacaccaagtagttactcattagtcaaaatactttttctgctgttgtttttaaaaagattaattgaagtattttattctaagaaagcagcttttccttcataaacacttaataattgcaaaatcataagatttttttacccttgaatggatgcttaatgatgcatccaataaactatattattgggatagtgtcctaactgatctcctgctcttacacatcctccatagctacccaccatgcaaacctaatcaaaaagcttctgttagctcctacagcctgttaatccaaagtccataaatttaaactaatcttatgtcttcagtgttacctcccctgttcatgataatgaaccaatatgcttcacttggttaatttaccattctaccacctaaagatcatttgcattcctagaactttgctcaaatgactctgcagccttaaatgccaaatgcctttcttcacctcctcttttcctgatgtccttttccttcctagatagcccaaagtttcatatcaactctcctctattgtttatttttattcccttcacaagtttttctattaccatgttacatactatttccatccattggttcatttgttcacttattgatatagttattcagtttatatttagagcttctattgtgttccacagtgctaagtaccagggttacaaaggtgaacaaaacaggtgcaccttctaatcttgtgaaacgtcagtaaacgagaggactgactccaatcaaataatcacataaagaaatgaaattgtaaagaaatgtgataatcaaataagaaaaagtgaatgtcatgaaggaaaggtctcctgtgccccaataacctattaataagagggtctctgaagaagtgaagcatagactagaagccggaaaccaagtaacagctaaggtaagaaagaaatgagtatttcatttgtaggatgtagaaggagaaggagggcaagaaaaagggcctgtggtaagactagtgtagctagaacaggcacagcaaggataaagaaacagggaccaaaccgggcagccttcaaaggccatgtatttaagaaaaataaaacaaaacaaaacagctttatggacacatgaatacatttagactaaatttcaattttaaagatgatttgtttgctatatggagaatactttgaaaggatctattttcaaagatgaaaatagagcagttaagaatcattgtacttgtccaggcgaagtgtgataggacgcctggattagagtggtgggctggtaggtatggatggaagtggacagattggacagagaagggtcgaagaagactattctgtttctagatttcatgtgtcagtggatgaatattggtgccattcactgaaacagcaacactggaagagggtctagattgaaagagaggatcatgagtaatctttatggatatattattcaaaaagaggtaagaagtaggcagaggagagtgtggcctggagatacttaatgttagtgtttgtggaaatagatggcgattagtgggtaaggatatagttgcctactgaaagtttagaggtaacataaggaaaagaacaaagaatccaggatcaagactcaatttaatagctagatatggtctaggaaaggcaacatacagagaggcaggaaaaacattagtagggatgtggtatcattctggcacattactgctttgtggtattaatgaacaatttaacatgtacacattgcatcatttggaatgatgttatgctcctggaaatgtgagatttccgttttatgtttcttatgtaacacctctctgttttcttgcagaacccaacagatacttgctgaatgaaaatgttcataacttcatgaattgaatatactggcaaagtgttttaggaaaaacacattttaggagaaaatgttctcctttaagtggcattattttataccaaataatattctagttgatctttttgcttatatagggaaccactttcacattttttaaaaaagtaaaaagtcaagttggagaaactgccaatacctattgcttccaaaagaaggcttatttggtctggagaagtaaaagtaaaaacatggagaatgaaatacgtgatatttggccaaaatgaaggaaagacagtaaaagagtacactgagaaattatacatgttttcatatttacctagcatctttttggtcatcttgttttgtttttcatgatctgtcttgctggtggtgctatcaatgttgtgttctcatttttgctgtccttagaagtccatttgcttgactacacatctaaaactgattcctgtaagatcaatctgactagagaagccagtttaaacccttttactcctaggatgagaaaatctcgacaaagatttgcccacagggataaacaatgtgtggaagaaaaaaccaaaaagccatttagaaataacattattacttgtgtaaaaaacttctctgtatgctttctagtagacatgaaaatgtagactcaaatatttgagaagtctgaaaatccacttgagaaatgtgtgtaacaatttattataattgcaaacccaattaaaaatgttgagctattgaacacaattcattttataatccatgaatatattaaatgtatgtagcacagatttatgttactataaaaatctttatttctacttttccagcattatgcatttaaatttgtaaattctatgttacattaatcacatgaatatagatgggcaacttcactacatttcctataaaagaaatcatgcctactgacaattttgtaggaaattttgttaaagattgactgtagctcataaaacagtaaggtttccttcacgaaagttattagacattttagatcccctcagtttgattgaaatgataaaaaaattacactttaatatcactgtctttggacactgacactgtatttaatactatacagaatacggtcacagagtcattaaaagaagtgacaataatccaggtttgactacactgtgatttaatatttacagtgttttcatgatacaagtaaaatatgctgattaaaatgatcacaatgtcaccatctgaatggacaaaaaagctgaggttcacatcttcagtataagacaccttcagttatttctttccactatcttttcttattaccaatacaatttctattatatgaaagcccattagtgtacagagaaataatatgcagtagagaagtcttttgtcaataaatataatatcttaaataattagggaagttactataaatattagagaagttattatgctacttaaatacagtaggtctgaactgtccctctttaagatcggtgttatcaagtgtaaaagattttcagatgaacaaatactttactagaagtgtctgaatgtttgtcttctacctgatcagtacagtaaagtttttaatgtgatttttttgtgtgacctaattgaagtaggtcacaaacaatgaagtaaagggatttaggattgtatattcagtctttaaaaatcagttataaacgtgtacacttggtaatttccaaagaagcagctaaacaatatccttgcctgattgtacaagacattctgatagtttctacagatgtgctgaattctaacaggagattggcaagcagcaaagaatgaccgtgctttgggcttagaaggataaccatattgtggaagattaaatatcttctggatgaagaatgaggcttgcccccatgaccacagtaggaattctattaaacttgatgtaatatttttctagataaaagaattttgaagaagatttatgtcatagaacttgaaggttccaaattctctttgatctatatgctagaggggaacctgggaaatttcaaggagaaacttacctcttttcacaggagctacctaagcccacctctgggctaaaaagtgcagtctttgattcagacacctgtgcttgtcagacccttcaatttttataagagcatgacattcctacctgtgcctatgctatcccttggagcataagggtctatatgcattcaccctgcacctaactcattaagaaatgttgttgcctctaccttcaaaatgctgtatggccataaactcaggaaacacagatgaatatacacaataaatgatttattgatattactttgcaaaaaaaatataaatgatttgggtctccacagtccttgttgctatgatgaacatgtcaatcaggcttctgcattagaaactttgattacagggaactggctgtttcctctccctgagatgctcttcctctaactctcacctctactaaacctttgctcaaaatcactttcacaacaatgattacccagaaaagttctacttaaaattgggaaccacagtccaatcccaatatttctatttctctcttattgtgatcttgttttctcaatggctttaacgccttctaacatagcatgtaatttatttgtcatgttttgtgttgtgtggtgttgtttgtgtttctctcctgtgttgtgttgttattgtccctctcccctgttagaatgtaattgatgtgaggacatagaactttgttttgttcactgatatatctcaagtgcctggtaatgatgcatccaatacatctttgttaattaaatatatctctgctaggaatgaaactttaaacttattcaatatcgatcaaaatctggaattagtcctacattattccagatcagcagttagccatgtacacaggatcatttcaacacataagaaaatgcttttataccactgtattttgtcttatcccattgacctataaaataagactagaaacaataccatgctttttttcctgaggaattaagtgctggctttggatgcacatatactaagattggaatgatacagagaatattagtatggttcctacacaaggaagtaaggaattatgtcaactgggacccaaggatcaggatctctaaatttgaggccaagagtagttttgtttatcatgagcaacaggtcccgcttattctgttagacattatggtcttataacatcatttgaacatcagcacaacattaagtacatgccatgtgtgaggcactgagtataataagcaatatcaacatatttagtcaatggcctctagaatcctatgtgccaagggagattatagacaaataaataggcaacttcaatattatgaaatgagtgtcaatgtatagtgaatacagagagttctgggaggacataagaggaatgcctaatccaatattggaaacttgggtatgacatcctagagtaattaacctcaaagttgaggtttacagaacaaatagaagttggctgtttaggaaggtgagttagaggttttcagacagaagagggaaataacatgtatgacgactcaaagttaagtaaagcagtcaggagatggagaccatctggccaacatagtgaaaccccgtctctactaaaatacaaaaattagcagtgcgtggtggcacgcgcctgtattcccagttacttgggaggcttaggcaggaggattgcttgaacccaagaggcagagtttacagtgagctgagatcatgccactgaactccagtctggtgacagagcgaaactacatctcaaaaaaaaaaaagcaaacaaacaaaaaaaaagttaagcatagctaaatttgtagaactgaaagaaatgcaatataattgcatcatgaagtgcaagaggggaagtggcaggcgagaaagccagaaagatttgcatagcctgattataacaagcctcactaggcagattaagaagttacactttatgataagggtaaggggaggtcatttaagacatttaagcaagaaatggctattgaatacatataaactagaagtgtaggattagctacttgatggaattactggggatagattctatttcctctaaagagtatatgtctgcctcaacagtggaaaggatagtaggaggtagtgtaataggaaatgaggtagaaacattttaaatacaactatggggcacaacatctgagtaggcaatcagaggacttgtagatagtgttaatatttagatagcattgaagactaggaaactctaatggtaccaatctctgcataatgtggcatttcttccactgtgattagcagagaaagaggatgataccattaatgcaaggttagatgttttctagttgtatgtgggtcaaggcaaaaaaaaaaaccatgcaaatgtgtgcaagatagtgcttctgatgatagaattcttggtcttggctagtaagggaagagaggtcagcctttaaggaactgaaagagtaggatttggaagtctgagatccaagacagatgtattttaagaaacttaattaaatctagatctgaaaaaaaagtagtgctgtagtgaagccatatatatgcctatatacattatcttgtgtatatatttataacaagcttaaaaagtcttaaggattaacatactcagctattgttcttgacgtgatcagaatgagtaaagaagaattagcaatgaagtaaaattctcactatgtcatccaaggttatcgatgccttgtttgtctaccacctaaagttgtctcatgacaacaagcaattagcaccatagttctggaaatactgtgttaagaaaaggaagattcctaagaatatgtgcagcatgtcatggaatttgtatattatgaaatggggtctcacatgtcataaaaaaatgtaagcagcagacatttggatctggccagagcaagaatagctgtatgagaatgggaattagtaatgaagatccctagccaaaacttttctggttttattggtcaccaaagacattaaggtttctaaatggaatgagattgcctgggctataagatttccagaataatcaattcctagcttgcttgataggagattaagacctccgtgtaaagaacaaattgcaactttaattgattttgcttctgaaggagactttgttctagtgggtaggtaatgaagttttctagtttattaggatcttttatattttgaaaacagtatgagcccttaagaaagaaatgtacagccaaatcctggttcatctttatcagaagggcctatgctaggactgtgcaaaccttttataccgagacttcaccctaatttcatcttagtttgttgactttcatttgtttttgcctttgtcctattttcctttacagtgacatataaccatcctcccctttactaactacttatggatgcaggatggaaaatatttatactatttttgcatactttgaaggtttaaacatcagcaaagtgaaaacaactgacctcaaaacatgatctaacccaaagtgagcaccttctgggagatggttttctgcttgacaatactttgtaatgaacttcatctcttatactgaggtagatgtcactattaaccaaaagcaggagctctgtaatggaagaattgaattaagatgcagatttctaagcaagaagagaaacatagagaccaggatagagcacagggcttggatggagcataccaacaaagagaaaataatgtgaggggtttaactttgtttcttttaccctggattttaaaaacagtcatattaaggatcaagtttattttttatttgttgtatcattcttatttcttccaggtagtctcaaatctcccgtaaacatttttgcaacacaaagttttcatgtcgtgggattgaagggactttagtggtgggcagtaaaaggaaaaacaggcttccatgtatcacaactcagctgcgtttaaagctccatcagcagtggtatatggaggaaagcaggagccttgcaaatttattctgtaaccaactgcaaagttagcaagggcttatagccaaactgagagcaactaaagcaaatagtatctaatgactgaggaaaagaagcccttcccatgtctatgggttttttaaattttctaataatgtattggtacaagtcccccagaaggctgaaggattaaggaaacccaggtgattgcaatcagaactatgttctgggatttattttcataagtgaatttatttaggatatgagttatagatattgtatgatttatatatgaatttaaagataactctaaaacctttcttaaaaagcagagtattaacaccaacatggcacatgtatacatacataataaacctgcacgttgtgcacatgtaccctaaaacttaaagtataataaaaaagcagagtattaatttattaatctgtctaatgagtttaaattttcttaggggtcaatcatgactatatgtaaagagtttaagcaatgaagcatatttgtttcaataaaccaaacttgacataaaaataattaatattaattattaattgaataaatacagcatgctttatccccagacctaaagtaacaccataagttttgaaacaagaatcataacataccaaaaaaaatttaccatgtcttcttaaattattacatatcttaagtgataatatttgatggggtttcaaatttagcagggaagcattattttatataacacatccaaattattaaacttgttacacaattttgtgatatattacatttgttttaacaaaactaattagtcatataattattctaatagcactgaaactcatttttaaagagacaaatttatattcagtccaaatttggccaatgttagtaacagacagacatgactactatgtagacatcgatagtaagtaaacactttctttggaacgcattggcataatgggaaagaaacggaaagaaatgtctttctggagaaagagtgagaaatcttcaagtctatatgatttacagtgaaatttatcctcacaggaaagcctaagaaaattatttatcaagtaattccatacagataagcatacttattttcatagcaatgtaactaagctaaggtcactcaggcatagagcagggtaaatcagatgttttataatattttaacaggtctttttaaaattaatgatacaatttaatttcttgtatcttaaatctcaaataaataatcgtgaacataaatactaattcacaaatatatgccacttgagtcttttggagaaagcagttaaacaactggcttataatccatttctcttctgttatcaggggtatgatccagggaaagaaagaaaggtaggggtatcaatttcttgtaaacaagctgacaactaaacctgctaccaaatagatgctaggatgagaatccttatctatgaatgttttcagtaggatgcctctagtttaggattgtttctggtaaataaatgtatttacaatctatggatttataaagtatagctccatggaaaatgttatgtaagctatacagctatatgaagacagtttattacctcaatactcccttgtatgcttggtagctcatgtaccatacttagagacttcatctgtttttctgggtcagaaagcatgtgtctaatgcaaagaaggactgggtagttgtcatcaatgtccctaaactgctttgtcttacccagtattagtaaactgatactgggtaagatctcttatttgtgcaaggctgatttgccagtctaatcttttgaattattgcaactctttatagtcctttctataaatgttgtataaactaagagtaaaacttgaaaggttccaaattcccagaagttaaagaatggttaagccatctacaacataactgcgaaatagaatagtatattgccaactatattttgaaaggtgaaataatcagttacatgccaaaatccacatgaaattctattcaatgcaaaaagagagagtgcacttcatgctatgattaagtaacgtggtatgtagacaatgacaggcattagaagaagtacatagattttaaaaatagaattaaaataaaaaattgtgttgtaaagagttttagaaaagggaaggtcaacatacgcaagaaaaacagtgtgctagtctagtcattaagacttcacaaatattccagttcttaaatacacatggtaggactgcacttctccatcccttttcaagttataagtgtctatgtgaatttctttggccaataatgcaagaagtaatatgtgccatttcttacatacattttaagagccagtttgtaatttatcatgttttcttcccactgctttagtgactgtgggagaaactgctgagatgtagccttgtcagcccgagaccctgggtatctacaatgagcagagagcccctactgactcacactggatatatactccaagaacttctggatgagctttctcctgagccataaacaagttcatcttgactgactcagcaagaaaaggttaataggagtgtgatgtattcatttcataacatctttttaaactaaaaagagctaagcaaagtttgtgcaaacaaagaattttagtactataggatatcagtgaggagtacatagcagggagtggacctgataatattgcagacaagaaacaaatgggtgtagaaggtaacgctaaagaaaagagtggaaataaaggtggcttggatgttttatacctggcagataaattgtaatgccatttatttagagagggaatatttgagagcagaggggaaaagttgagaatatttatttttgccctgaggccattagatgtatctagctgatggctgaaaatgaaagtctgaaattcaaaagagaagtcagggatatagagaagacagagaagagaaagcagtctcacacgtactatgaactggtaattcttctaagtcttttaaatataatatctcctataatgattgtaattttaccattccactggaagaaatgaggcactctaagagattaagctacccagatttggcagtactatccataaaggaacaaataaagcctgagagatattatagaggaaacaggcaaggagactggaaagactatattcagggggcaggcaaaagaaacaggacactaaataggaacagacacttttacaaccaagtgacagagaataggtgccactgaggccaacagggaaaatatcaagaagtaatggattgttgttcatgtcgaatgctccagagaaaactaactagatttatcatcttcaaactattgaattttgcttccaaatagataacttgagaggcaaaagctgaaaattacttcgtttttaatatactgatattctgtaggctgtcaaactgaacaaatctcaaagatgaggcattttatgagcactacacctcatgtttgcctaaattaaaataagaattaagtatcattaggaatactttttaaatttcttcagataaaaaaagtctccagcaaagatgacccaactgatgttgaatgaaccccttaacaggactaagtcatacaggtaaattaatcccataaattgctctcaaaaggaatctgaatctcagggctgatgttggtgtgccagcaacacacgttcctgatgggtcataatgtttaatgagatgcatgggaacctctgaattggatgaatattcaagtgatcttcagggaaatcctgaattagaatcagctccaataatttaattgaaaggtcacataactgagtgactattataaaatctataatataatggaagcactgtactcgcacaagtggcagttaagaactttaggtcaagggcttatctcatttttagactcataataagacaatactctttacttttagaaaatgtcaacattcctctaaggaaaaattactatattacttaagagaaaacatttgcactttttctattaactatatccgaagagggtaaggaaggcgtatatcacatctgtagaaacattttttaaaaaaatacttggaatactatatgtttttgccaatccttagaagtgatcaacggttcttgcagatactgattctattattagaaaacagcttttgatttacctgtttgtccaacaggggtctccgcttttgttgttttgtacttgtattacttttattcttaaaaaactagtgaaagcaaaacttcaaatacaacttcacctaagtgaagaatgtttacaacatttaatggtcatttagtgaataaacttaaccaacataataagaattaattcaattttttcattagaaagttgttatcagtttccaagcaaaaactatgcatttatataaccctgttagtcaaatttactttcatatacttcagggaataatgtccactgcataccctcaaaactaacaatataggacacagccaattttaaaattaaaatattttgaacattgtctactctgattataattagcacagatgttatttacttttcctttattctcatcaaatgtagattaaaaataaaactgaatttctgccatcaagataattaacattttataatatagttccatgtcattgatatccaacctgttctttatttaaataaaaatttatttcattttttaaaaattgtattttaaagttttcatgcctatcaaacgcccattcttaggcactatccaattattttccatatctaggtatacatacaacctgcccatcccttctctgcttgagttccaattaactcagaaattcagcaggctccttatgactgcaatgtcagtatccttcaaagtcttctgctccacgttgaagtaacatattagtgatctcaaaatagttcttaaaattttctttctattatgcccctttacaagcataagttaattggcccaaggccaatatttaaaaaaaaaaaaaaaaaaggccacatgacctaaaaacgaaatgctgcttttttataatttttaaatgtaatgtttcctgtaagcagccttgatacgtaaaatagtaacgcttttgtgtgtgtttctgagacagagtcttgctctgttgcccaggctggagtgcagtgacgcaatcacagctcaccatagctttgatctcccgggcacaagcaatcctccagcttcagcctcccatgtagctgggactacaggcacatgccaccatgccctggaagattttttttttttttttgtagagatagggtctcaccttgttgcccaggctagtctcaaaatcctgggcccaactgatcctcccgcctaggcatccaaaagggttgggattacaggtgttagccaccatgccaggctaaaataaatagtaactttctaataacatatatatatatacctatatgtttgtacctatatatgttccacattttttgtgtggattttagacacccctaaaatacattaaataaactagaagcattcaaataacaaataaaaataatgatggacagtcatgtgataagccagaaaaacaatgaagtcagatgtgtcattgtgaaagactctttatctccgtgacagaagtaatatgaaatgtgcaatagccaaaatatttaaaatcatgtaagtgagctgtgtccacttgaaaaacttgactcttttgctgtgaatccatctggtcctggactctttttggttggtaaactattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcacctttatcattttttattgcgtcaatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagctcttgtaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttaggtacccagtagtcattcaggagcaggttgttcagtttccatgtagttgagtggttttgagtgagtttcttaatcctgagttctagtttgagtgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttaaggaggaactggtaccattccttctgaaactattccaatcaatagaaaaagagggaatcctccctaactcattttatgaggccagcatcatcctgataccaaagccaggcagagacacaaacaaaaaagagaattttagaccaatatccttgatgaacattgatgcaaaaatcttcaataaaatactggcaaaccgaatccagcagcacatcaaaaagtttatccaccatgatcaagtgggcttcatccctgggatgcaagactggttcaatatacacaaatcaataaatgtaatccagcatataaacagaaccaaagacaaaaaccacatgattatctcaatagatgcagaaaaggcctttgacaaaattcaataactcttcacgctaaaaactctcaataaattaggtattgatgggacatatctcaaataataagagctatctatgacaaacccacagtcaatatcatactgaatgggcaaaaactggaagccttccctttgaaaactggcacaagacagggatgccctctctcaccactcctattcaacatagtgttggaagttctggccagggcaattaggcaggagaaggaaataaagtgtattcaattaggaaaagagggagtcaaattgtccctgtttgcagatgacatgattgtatatccagaaaaccccactgtctcagcccaaaatctccttaagctgagaagcaacttcagcaaagtctcagaatacaaaatcaaagtacaaaaatcacaagcattcttatacaccaataacagacaaacagagagccaaatgatgagtgaactcccattcacaattacttcaaagagaataaaatacttaggaatccaacttacaagggacgtgaaggacctcttcaaggagaactacaaaccactgctcattgaaataaaagaggatacaaacaaatggaagaaaattccatgctcatgggtaggaagaatcaatatcgtgaaaatggtcatactgcccaaggcaatttatagattcaatgccatccccatcaagctaccaatgactttcctcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatctagatcaatggaacagaacagagccctcagaaataatgccgcatatctacaactatctgatctttgacaaacctgaaaaaaacaagcaatggggaaaggattccctatttaataaatggtgctgggaaaactggctagccatatgtagaaagctgaaactggatcccttccttacaccttatacaaaaattaattcaagatggattaaacacttaaacgttagacctaaaaccataaaaacccgagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacagagggctaatatccagaatctacaatgaactcaaacaaatttacaagaagaaaacaaacaaccccatcaaaaagtgggcaaaggacatgaacagacacttctcaaaagaagacatttatgcagccaaaagacacatgaaaaaatgctcatcatccctggccatcagagaaatgcaaatcaaaaccacaatgagataccatctcacaccagttacaatggcgatcattaaaaagtcaggaaacaggccaggcgcggtggctcacgcctgtaatcccagcactttgggaggccgaggcgggtggatcatgaggtcaggagatcgagaccatcctggctaacaaggtgaaaccccgtctctaccaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatctatgtttattgcggcattattcacaatagcaaagacttggaaccaacgcaaatatccaacaatgatagactggattaagaaaatgtggcacatatacaccttggaatactatgcagccataaaaaatgatgagctcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtggggggagaggggagggatagcattaggcgatacacctaatgctaaatgacgagttaatgggtgcagcacaccagcatggcacatgtatacatatgtaactaacctgtacatggtgcacatgtaccctaaaacttaaagtataataataaaaaaaagagttctacaaatgtttaggttgcactactactgtttgaataaagatattgcttgataactaaaaaaagaaagaatgaataaatgtatacttaattatttaataccttccttctccatcccacaagatgtgagctccataatggaagggctgtgtttgccttggtttctgctgtatatcctggttttgtacagtacactatgcctatgtagctgctaaatgaaaaaataaaggattaactaaacttattaaaaaaaaaagaaaaacttgactctttcacgacagatggtgaacagtaaggctattctcaacttatatcaataatggggtagaaaagttggcagtgcggtaacactgagcaacagagacacacgaatttattgagtgtctagttcactggtaaataaaatgaaagaaattctgtaaaaatgttttcttgacatatttttcatagcaatctactggcattttctgttctatccattaagttactaaacatgatgatttcccaggggtcatttctatatcacactgagacacttggctcttgttacctgaatctggaaagagcttagacttgtgtcaaagcacattctaatttaccctttatcactatcctttttaaagaaagttttcaaagtataaaaagtatattcacttaacaacaagttttacaggttaaaattagcattaaaacaaaaatttaaatagtaatagtttaaaagttcatgtgttcaaaacaaaattaaactttggcttccaaattgctaaaatgaatttggacaaagcattgttttaatctactatagtaaatatttgtttttcattcaaaacagataatccaaaacaagtcgattttatcagctaataactgataatactgaaatgaaaataaataaggtttaattttacgttttgcaatgatgtgttactctaactaaactgactggataaaatatgtgtattttagttttttgtaatctcatgctctatatattttattgcttttataaataaataaatctagaattaaagttggacaaactgtataacatcaagtaattataaaactatgttaaaatatttaagaatgaatttgtgaatataacttttgcttctttaaaataaaaaggaatgactttataatatgcttaaaatattgcttatctgtttttctctctccagaattaaaaaaaaacatataagcatatataagtttaaagtaatataaattatagttcctgcctaaatttttacccataactcacttcttagaacacacagagttaccactgaaatcaaagttagttacatgtttactgaactgtattggctgaggttttgaaaatatctacaggctgtatgtatggtatctatcctttttcatcgaatagactatgatttcatcattatattttataaccactttttaatccagaaatgcaaaatatgagagctgcaaaagtaaatattccaccatccttatgaatatttcattacacaatatgtttatttagttacaatttttttggaagagccaaactaattcattgcacatttatttagtacatctactgtcactattgtagtaggttgaatggtgctccgccaccccgccccccaaccaaaatatattcatgtccaaatccctggaacctgtgaatattacattatttgaaaaagtctcattacagatgtacttaatttaaggacttctatggtttagatatggtttattcggccatgccaagtctcatgttaaaattgattcccagtgttgaggtgaggcctggtggaaggtgtctgggatgtggaagcagatccctcatgaacagcttggtgtgcaggagtgagtcctcactattagtatccgggataactggttgttgaaaagagactagcacctcctctctctcttctcctttctcgccctgtaatgtctgctcctctctgcctgtcaccataactggaagcagtctgaggctcttaccagatgcagatgccagcactatgcttcttgtacaacctgcagaactatgagccaaataaacctctttataaattatccagcttcaggtatttctttacagcaacacaaatgaactatggaaaggatcttgagatgggatcatcctagattacccagatgggccctaaatcccataacaagtgtccttctaagaaacaggagaaaagacacagacaaaagcggagcaggtgatgtgaagacggaggcagaaattgcagtgaagtggtcacaagtcaatgaagtcaagggatgcccacagccaacacaaactgaaagagacaaggaaaaattctcttctagaaccctcagagagagcatggcctggattatgccttgacttcagacttctagcctccagaactgtgagaattaaaagagtgttgttttaagccacagaggttgtggaaacttgttagagcagcctcaggaaacgaatatagctgtagacagtcaaagtgattagaggatgatataaatcaggaaatgtgactgacatgactgcaatttgcacaaatccaagagggtatggtgcctacataaggatcctacaacatagtttccatattttgtataattgaaactgctgtgctgttttgattgcgttctctctctcccttcctctctctctctccacccccactttgctctcttgctctctattgctgtatgatcccaaagagcatgatgttatttttatgggtatttatctactgatactatacaggtattgatccctcattctgtcttcagcattgctggaaatgcaacacaaatgaactaaggaaaggatcttgagatgggatcatcctagattacccagatgggccctaaatcccataacaagtgtccttctaagaaacaggagaaaagacacagataaaagtggagagaaggatgagtccagttgagaatgagttcctattaccggtgaagaaaccattccaattgcatccagtacatactaaaggaattcaaatccctttagggatagaaattactgcttctccaacctctgttctattccttctttcatactcacagaaacatgatttacttggaagaaattcgtggagattctgggatctcacagagaatggaatccttcccagtcacttctcagttacctaccacagaaaaacattcctaacagatacacaagtgagaattgcaaagtgagaaatcaatacgggttacaggaaacacaagatctaagaccagaggtgtgtaaaaggctggatacattttggagatctgaaagggaaaggaaagcgtactctagacagacaagcctggattaaagctttggggtgagaataagcacaacatgtgtgacctggaatagagaagaccgccctgcctcctagagagaagaagcatggatgtgatgggatattaaacccaggcacaggtttcatggagggaaaggaaagaatgtcttacgggaccagttttcattggttctctcatttccagaataagaatacaactaagtgtgaattaatagttttaactcttaacctaccactacccaccaaagagtcagagagcactagagtcatttggtgaaacaaacagagaagactaaaaaaaaaaaaaaaaaatcacagtctgaaaattcaagtaacttaaaaatatgctaatcttcctcttctaacagctctataaattctcagaaattttaaaagtacgacaacttgcttgagcattctggctacagaatatcagactggtgattatcactctgtaggaacttaacattgatcagtattttcagtggttttttttttttgacgatcttataaataagacttagtataactaacttattgtgttaagataggcaaagatgcagaatgctaaaatgtttctggaaaaaaaaatccctaaccattctgtttctaatttgtcttattttagttttgtttttcttggtagctgagtacttgcacaattcctcccaacacacttaaacactaaattatgaaatgaaatagtttcaaaggtcctcagtcttaagctgtcctttaaagaacatctcaagctttgacaaaaaccatggccaatctgtacagtggttttaattcttcgtttttactattgagaaatgtatagctcattctttttcaagagcttctagtaaagctttaaaagcaaccaataatgttgtaacattttaaatattggattaaaactctagatattttcttatttagatttatgtctagagaaagaaaaaacaggtgagtagatatgaaacatatctaaatcttgttgaattctagcagttgaagatctgcttcaaataaatatattttcttaaaaaaaggtatctcacaagaacactatacccaggtatgttttattttatttttaagtatgttacttaaaggtttaaaaaattctgtccacgtaatcttgaaaataaattacttgaagatgtctgtgagcttaatgagacatgaataacaatgcaataatgaggtagttattgcataaagaaattgcaggtcctttcctaattccttgtggacctcaaacttaggaagccaagtggatttgcaggcttgccccttccccctacatgaccagtgctgtcctctgagccactgcctcccttaacctctccgagtcttttacccatacccagcattagatgatggtggttatcatatttgagatgtcttaaaatcactgctgtggtttcctaccagttattactaacaatggctaaatcattgccactgttacaacaccacactgaaagaattactaagcaaaagtaattttcttctactgcaacaaaaacagaaaaacaaagatcaatgtaatggatttttttctgccaaggaatttaaataatacaactgtccctcagtatttgtgggggatggattccaggaaccctcagggagataaaaatcctcagatgttccagtatcttatataaaatggcatgatatttgcatacaacctatgtataacccccgccccccgccactttacatcatctctaggttacttctaatacagaatacaatgtaaacagttgttatactctattgtttcttattaatattttgtattactttattgtctttcttgttcaaatattttcaatatctggttgcttgaatacctagatgtgaaacctgtggacaaggagagttgcctgtaatttacagcatctttaatattcttatcaaattattgagattctccttttatttatttatttcttctatttggaaatacatctatcatcacccctctctttgtatcatcctataaggaagaactaagtgtggtttgtttttttttttagagacagagtcttgctatgtcacccaggctggagtgcagtggtgcaatttcggcttcactgcaacctccacctcctgggttcaagcaattttcctgcttcagcctcccgagtagctgggactacaggcgcatgctgccacacctggccaattttttgtgttttagtagagatggagtttcactgtgctgcccagggtggtctcgaacttcttgagttcaggcaatctgcccaccgtggcctcccaaaatgccaggattataggcgtgagccaccgcacccggccctatgtgtgttcttgaattaataatgcaataaagtcagcataaaatctgtatggcttaatatattcattaatttgatcatacaacaaatatttatgaagcatctactatgtatcaaacacttgttctagaaggaggggattcagtcgagaacaaaatagacaaaaaatatgccagcccttaggagtttatatttagcctggacagaaataaataagctacataagtaagatgagcagatttttttttttcttgagacggagttttgctctgtcgcccaggctggagtgcagtggcacaatctcggctcattgcaagatccacctcccgggttcaggccattctcctgcctcagcctcccgagtagctgggactacaggcgcccgccaccacacctggctaattttttgtattttagtagagatggggcttcactgtgttagccaggatggtctcgatctcctgacctcgtgatccgccctcctgggcctcccaaagtgctgggattacaggcgtgagccaccacgcccagttaagatgggcagatatttttaaaaaaattaataatattaaaaatacgcaggcaaaagactgacaaagtggagaatgtgtgaactttttagagacaaaggaaggcctctctgagaatgcaccttcatgtgaagacatgaaggatgtgactgagtagtcatgcagacacatgcaagggaagtccttcaggcaatccacctgtgagtgccaagccctgcctgtaagaacaatgtgtccagggtttatgtttgtgtttgctttatagaaaaggaaggacagggtggcagcagtagaaactgaagccagaagggcaatggtggaagttgcaaaatatataaagtttctatcctaattttaatgtagggccagatgagaggtactagagggcctgggcagaagagtgatgggcactcacagccttgtaaaagaattaggctgccggctcttttgagaagagactgaagaggggcctggagtaccagcaaatccatgagtgagaagatgctgccttggactgtctgattacagtttggatatattttttaaatgaagctaaaaagacctggtggactaaatgtagagatgggtgtcatcaacatagaccttaatgattttggtttgagccattgacaggaagcctgtaagaggagctagattaaggaagaatatatatttttaatgcaagtatgtaaaatggatgaaggcagtcagggagattttcatttccgattctattcttttccacaatgtttatgtgattcataaactactgtagtgatcagagaggcatttaaaataatatataaagttttacacatattagaatgtacaattttataatatatgcataacaaaaaagttgaataactctatatgacttttacaattccaaaaaatatatgacatttaaaactgtttataagtgaataaaaaggctgagtttgctgctgtaagataagcacaagtttttccagagaagcttgaacttgaatcctgattctgttacttgcttattatgtaaccttgtacacatttcttcatatactttaacatttagtgttctcctctttaaattatgtatatgcagcatttggcagtatttgttaattgtgaaaattaagcaaaatactctacatagaggcctctgcatattgactgaataaaaaaatcataatcgaaatcacaatattaatatggcaaacagcaaagagaataatgaaagtaaaaatagcagcttagatttcctgtgcagtccctattacaggatgagcaacattgtggtgagccctttacatgtattgttgagtgcgatctttacagcatacctctaaggtaggtgcccttattgtcccatttcacagaggaggaaaagttaacttgtagaaagaaaatacttcataggcagtagacagctagttatcgcaagacaaaagcccctgaagttcagacctgaaggcccatggcattttatcttatccatcctatccagaaagttgaatgccttccctgagccaggaaatctccacaacagtaagtaaatacctcttcatactcttataatatttaacattggagtaaatccaaggacagccaaaaaaaaaaaaaaaaatgactcaggcaaatggagatggtcttaaagatgaatccagctaatgcagggaggattagaaattaaagaaacctctaagtctgcacagataggggccaacattaattatgattaaacattggaaataatgttcaatctattttctctgaaataggttctttggtaaataaaacagtttgtgtttatattttttctggttctctgagatagttaaattttacacgtcaatttgactaggctacggtgcccaacttcttggtcaaatgctagtatagatattgctgtgaacatattttgtcgatgtgattaacatctacaatcagttgactttaagtaaaaaagatgacccttgataatagagttgggtctcatccagtgaattgaaagccttaagagcaaaaactgatttccctgagaagaggagcctcaagagtctaacacagaaatcctccctgaatttccagcctctttgccctacacattttagacttgccagcactcaaaatcacataagccaattcctcaaaataaatctacttacccatctatctattatacacacaaacacacacacacacacacacacacacacacacacacacacacatccttctggttctgtttctctggagaactgtagaaccctgagagataaactctccttttctttttaaatcagtttccatttatataattttattccctttaataaccgtatttttattacttttttaactttgatgcttttccagtgcttggtgttactttgggtttaatttctggcttgtctcctaacattctaaaggtcaacagcacacaatctaagtattcataattcaaaatgaaaagaaaatcatgaaatttcagaagacatttaatcaaaatttgatttacacctctaggactatctttcaacattataacagaagttttaaaaagttgaatttctaacgctgtagcaacatataaacaaatattaagtcactttttttcccccaagcttaaaaatgtgactaaatgtgaatggttattctctaaagataaaattttgtgttttggctgtatgtcattcttatttctaataagataatatcaacctaacatacctaatgacagtatttaatactcttaggaatgttctaggcaacgcagtttaacaattttgtcagtttttaaaatgtgagagagaaggattatagtcagcagttcctcagaaataaggctgagtaaatttagttgttcctatagaaaccaatcattaaagtttaaaaagaaaggatcagggatggaggcagagccaggtggctgaatagaagcctccaccaattgtcctccctgcaagaacaccagaccgaacaactatccacacaacaaagcaaacatcataagaaccaaaaatcagcttaggtagcagctcagccacagttgggtagagcaccaagcaggctcctgagagcccgattccaggccttggctcttggacggtgtttcttgacctgtactggaccagaggggagaccgctgccctgaagggagagtcccaggcctggcagcactcaccacaagttgatgactcaagggccctggggcctcgaatgaacattggctgtagccaggcagtactcactgtgagcctggggcagtggtggccatggggagagagtccactggttgtggaaaggggaggaaagggtgggaaggactttgtcttgtgccttctgtgccagctcagccacagcagaagagagtacctcgggaccaggagggaatttgccaccctgaagcaaacgacacaagcctggctggctttgtcacctgctgattgtagacccctaaggcctttagcaaacatacaaggtagccaggcagtggttactgtgggccttgagtgagatccagtgctgtgctggcttcaggtctgacccagtgctatcccagtgttggtggccacagaggtgcttgtgtcaccccctcccccagctccaggcagctcagagcagagagagagagactgcgtttgtttgggagaaagtaggggaagagatcctgagaattcttctgcatattatccaagaccatacaagtcaataatgaggggaattttggaaactacacaaatacatggaacttaaacaaaatgctcgtgaatgactagtgagtcagtgaagaaattaagaaggaaatttaaaaaattcttgagaaaaatgataatggcaagtaggtctatgaaaaggtgctcatagcattgatcatcagagaaatgcaaatcaaaattacaaaatataggcaatattattacaaatgccagtgaggacgtggaggaaaggcaacccttgtattatacactgttggtgggaatgtatttatcagtacaaccactatggaaaacaatttggaggttcctcaaaaaactaaaatagaactaccagatgatccagaaatcccactgctaggtatatacccaaaggaaaggaaatcagtatatcgaagagacagctgcactcccatgtttattgcagcacaattcacaatagccaagatttggaagcaaactaagtgttcatctacagatgaatggatttttaaagtgtggtacatatggacaatggagtactattcagtcataaaaaagaatgagatcctgtcatttgcaataacatggatggagctggagatcattatgttaaatgaaataagccagacacagaaagataaactttgcatattctcacttatttacaggagcacttatttacggagatagagagtagaatgatggttaccagaggctgaaaagggtagtgcagggggtagtggggtggggagtggggatggttaatgagcataaaaatataggtagatagaatgaataagatctaaagttggatagcacagcagggtaactgcagtcaacaataatttattgtacatttaaaaataactaaaagagtataattggatcatttctaacacatagggtaaatgcttgagaagatggataccccactttctgtgatgggattattacacattgtatgcctgaatgaaaatatctcatatgtgccatgaatatatacacctactatgaacccactaaaattaaaacttaaaagaaataaaagatcagttcagtacagacagtgcacatccagttttgacaaacttgaaaatatgtttatacagaacaggataaaataaaggctatggggtagttgggattttaaaagttacaacgcatgacaatgcacatatgaatataaattttagtattattgagatgtacaccaaatttagttctcaataatcacattttcagggtctcatagaagtttttataaaaatggatgaaaaacatagcaaagtatagaaaaataaccatgaaggtagttaaagtgaaaaagagatgttatgaccatgatttccaattgatgattggtgaccttcattgattggtgacctagtatgcatttctttgattctgttcttaaggagtaccctcatttttgttcatgtatcaacaccttagtcccatagctcataatcttcaaagaaagctaaaataaatctcatactccatgggacagtcttgattggctgagtttttcaacaaaaacagaagggatctaagtctgtccagccagagtgatcttgggactcttgctttgaaagcatttttgtgccctctctggtcatgcataaggatgcatatggccacagtagctgttggcagacatattacagccatggagaaaccagtgttaatactaagataaattttcgccacagaagatagaacagaaatattggaaaggaataacagaaaccagacttttagaaatatcattgagccaaccattctcaactctgtgtgagttgttatttaatctatatttaaatgatatttaatctatattaaattgaattttctgttacctagaactaaggaatcaggtcacaatacataataactatttttgaatatatgtgttgatagatattaacacatgcaactgaaaacataatggtcttaaggctgtaccatgagagattaaaattttatttaacaataagattttattattttaattgtttatgccaagtctgattttacagtctgggggcaagatgatagattatacaactacattcatagatatgtatgtcaagatgtaaagatattatttttcactcctgtgatagtttaattcttaaacctgtctaaagagaaagatgagtatacaattttccaaagtgcctactggcaccatgatcctgttctacagcaaagtttattttagtaaaaatatgaaaaaacacatccatataacaggaatttaaattacaattatttgtctcacagttaaacatcactatcacacacctatcaaaaaggaagtttaatttttaaaaaaaggaaacgtaagcactatttggtctttccactaatgtcttggtaaactgaccaaagccacatctttagaagcagtgattgttttttccctgttcctctgagaatctacaaataattacttctatctcatttttaaatattgtagcatttttttggtttttatatattaggttttaatatttgagcctgattaaagtatatttatgaacaagaatatactcgataaaacaattagtaaagttgctccaggcactagagggaaaatatgtatttatgtataaaacaagagataaatttgtagcaaatgtaaggtaaacaaaaatgagaatgtgaagttctatttcagaccccaaggaaataaaatactaaaatcagaatgcacaaccaacccttgttcattagaaaataatgtgataaaatatcatttattttcaaaatgcgtgagttatagaataaattgagcatagtcagccatgcagaattaaactccacaagaaaacaagaaagaaatctaaaagatatctgtagcatgggtaagaaaataaaaaattcaccataaacagaaatgatgtttttgtgtaactaaaattaaatatttcaaaagctagagaaaatatctaattactctgtttcctgtatgtatacacaaaatacatatttgttttatgaatgacttttaacttgctaatataaaaccacagcttcaactctttactactgctagcccatattctattattaacctttgtatatgaaaatagtatttttcttaggtgtacttcttcaatgtcaaagctagtaatgtaaatgattaaaatattaaaagatttaaagggaactggtgaatgtatggatgcattggtaagccaaatcaccattttcttcttctctatggacatcacagagttcataataaatattttataagctatatgtccagtgacctctatcatcactaccagttggaatcaactgataagaggtcacatacacagctttacatttaagtaaattacaataattttaactttataaatatatgaagaacagtatggcttttgtattttgatgttttaatatgattgtcaaaaggattatctttttgatatcctaacatgtgtgagatgccatctcattatggttttcattggaatttcactcagtgatgttgagcaccttatcatacatctattcgccattctcatgtcttctagagaaatgtctattcaggatctttgccctctctttaattggtttatttaactatttgcgattgactcatatgagttacctatatatttcggatattaatcccttacaagatttatggttggcaaatatcttctcacaatctgcaggccatcatttcattttcttgattgtttcctttgttgtgcagaagctttttagactgatgtggccccacttgtttatttttgcttttgatacctgagcttttgctgtgacatccaaaaaatcatagtcaagggggtattcctctacatttttttcttctaggagttttatggtttcagagcttatgtttaagttttcaatctattttgagttcatttttatatgttatataagacaaggtccagggaatctttgaacactctttgtgggaatgtaatctggtgcagccattatggaaaatagtatggaagttcctcaaaaaaaattaaaagtctaataactatatgacctagcaacccctcttttcagtatatgcccagatgaaataatatcatacagatatctgcactcccatgttcactgcagcattatttacaggaaccaacttttaatcaacctgagtgtccattgattaattaatagataagaaacttatataatggaatattattaagccttataaaagaaggagattctgtcatttgtgacaatgtggatgaacccggaggaattatgcaaagtttaaaaagccagacacagaaagaagaatactgaatgatctcacttacatatgaaatctaaaacaataaaatttgaatacatagaaatagagcagaatagtggttactggggtgggtgtaaggaatgggggaaatataagtcaaatggtacaaagttcttatgtaggatgaataagcctggagatctaatgtacagtatgagtactatggcaataatattgtattacgtaatagaaatttgctgagagagtagattgtcagtgctcttaccacacacatgaagataacaatatgaggtgatggatatgtaaatctatctgactatagtaatcattttactatatatatgtatttaacacatcacattgtataccttaaatttatacaaaaaagaacaaaatatttttaccatttacatatatctgaaaaatccctttttaatattttcattattatatgagttaatctaatattaatagctacttatatagaaatccaaactcagttccacttgtagtattaaaaaaaatgacaaagtaattaaaaacctcctcttaggcaagagaaggaaaaaataaaatgaaagctttatatttgaggtgatatgaacaaaacaataagttacggttgtagttcattttaaccagcgacttattgtatagctgcaagatctctactgtatcattttctaagtgattttggtcccatccactaatttcagattcccagccctgtattaaatgatttccttgaggaatgaatgaatgatttccttgtgataaatgaatatttctaaatatctaaaattatagctaataagaccaaataaactaaaagcaatgaggaaattgtgagaataaacttgatttgctacaccttatagttaaattatattttatatggattagtttatttttagcagtcaatattcaaatttatatgtcttttttttccaagggacatagaaataagtattgttatagtcagtttatgaagtatctattatgaaacttaaataaaagctaaatgaaaattggatttgtgcaacataaggaaagcaatcactgacaactttgttaaaaggtgttatttgattttacctttcaaaaatacatatcatatgttcaggtgaatgttgttaatttcaaagttgtaatcttatctgtatttcataccccctcacattcttcatatttgcaaagctttgtttttaaaggcatatatattagaccaaagtcagataaatatagtagcacagttcagagactataatagtttatattgtaatcccataagcagattcagaaggaagtttcaaaaaaatagtttccaaaaattatttgtgcaatatcaacatacttagattaaatatatcacttctaaaagtgattcattttggggtacagtatctgctttaaaaatgtgaatctcattagtttgtaattagatcttaaaatataactcagcttgaagaaatttctctatagttcattgatgtgtttttatactcaataaaacaagatgtttaaatatctgaatttaagattcaagtaggataaataaaaagaagcttctggtagctaaagaagcaggtgttaactgaatctaccctgataactcagatgttatgaaatatggtcttttaggctaatacatcctaccagaacattcagaactgaaagtgattaacaagccaatgcttcccaatcaataaggggatgcatgcctactattagaaatgcagataagatgtatcatgcatcccctctacgagtcaacattttaaaacacttattaagaacttgctatttgcaaggcaatttagaagttcgaataaaagaatgtgggtacgtatgaagaaataaccaaagacagaatgtgattgtctaaagtataagaatattttcattctgacatttattttattaaatataatctcagttacatgggaacaaagtggagggatcacttatctgttttaacgaggcagtttttcaataattcaaaatataaggcaaatcaattgtattccattgtaaagaaaaaaatccatattattttgtagcattataacacaagtaaaacactatctaatgtctccctaattttctcgtttattatttgtcttcctgatttttttcattctatatgttattgaagataaacatctattatttactttaaaaatagttctaaacaatgagaatagatcataactattgaattataatcgacccaactctgtgtgcctatagaattaaaacaacctagatttgtcatacaatatcaatacattaaaaatgtttactaaatagtatgagtggtaatatccactaggaacttacatttttagataagtcatgtatagatttgttcaaaaaattatgcttttaaaattcaaaattcatacattaacaactattaatcaggatgctgtgatttttggcagtaaaaaacgctatttattgtattatttattctattactttactttgagaagtggcttatctccaattagaaaaataaatatttaatttaaagaaattaacatatatatttgaagaagacactgtccaatctggaagagtatgaacctggtaaagatattatatggggatatgtgaaagctgaattaacgtacatttttttctggcaaacaaaagatttcatttcactgataactgaaacaaaatggtgaaataacaggaaagagacataagttaaaagaggaccacaaaaataaatctcagcttggaaaataccattctgcatcaattctattggtgaaaggagatgagagtgaaaacagaatattaatgctgtaataaacaaacatgaataacagctataaattaaagatatatatctgatatatatgattactgaaaaatataagtgaacaggataataactattcctttaaaaaattaagtgttgaaaaattcagggcaagagatactaaaatgaactcaaaaatctcaatccaattttcataattattcgtattccttatgaaatcaattatttgcaaatctgataatattttgccaaatgttttaatttactctttttattatataggttgataaaattaaaaggaaaacatttgtttcccattgtctgctttttatacaaaaggagtgtctactttactaaatgacacattttctcaatgttaatataatccatatgtgaaattatgtagctaaatattccttaagagcacatttgttctattttaaaaatctatgctaaaatcacaacaaaaacatctgctcatatctagaaatgaaagtatttttaaaacataatttaaattctatgatgtgcacatcactctggaggaagatgagtattttgaagaaaaaatgttcagttgcatttcacaaaaaggccttcttagtgaggagagaagttatgaaaatagatttagaataagaaaagtacacaagtagctatattatacttaaatatagcatacactgggttacaattcattttcttcgtacaaaacaataattttgctaaagcaccaacactgcttggcagatgacttagtaaggtgtgggcagcagacaggagaaatgaaaatgaattgggctagaaaatgatggctgctgtcaaggattgacacccagagagaaagtccaattaaagttaagaaatatggacagaagaagtcctagccagagaagtctaacatccagaatctataaggaacttaaatcaacaaggaaaaaaacaaccccagtaaaaattgggcaaaggacatggacagacacttatcaaaagaagatatacaagaagccaacaagcatgtgaaaaaaatgctcatcatcacttaacagagaaattcaaatcaaaaaccacaatgagataccatctcacaccagtcagatactattaaaaaatcaaaaaacaacagatgctggcaaggctgtggagaaaagggaacacttactcactgttggtgggaatgtaaactagttcagccactatagaaggcagtttggagatttcccaaagaacttaaaacagagctactgtaagatccagcaatcccattactgggtatgtactcaaaggaagacagatcattataccaacaagacacatgcactcataagttcattgctgcactattcacaatagcaaaaacatggaatcaaattatgtgctaatggtggattggataaagaaaatgtagtacatataaactacagaataatatacagtcatgaaaaagaatgaaattatatgcctcttagcaacatggatggagctggaggccatgattcaaaaattaatgcaggatcagaatactaaatactacacattctcacttacaagtggtagctaaacattgagcacacatggatgtaaacctgggaacaataaacactgcagactactagagagtggaggagaggaagagggtgtaggttgaaaatctacctattggatactatcctccctacctggatgcaatatacccatgtaaccaacctgcacatgtgccccctgtaactaaagtaaaagttaaattaagaataataaagaaatccagtgtgtattttatacttacattacatttcaatttggaatagtggagtgttcaatagcccatgtagctagtggctgccctattggacaacacaggcctggagtttttctggaagaggcctcaaaaaaaaagttaacaggggttgcttctcaggaagagaactaagagactaggggtaaaaagagatagcaaccttacttttaaccacaaacccttctgtattgcttgaattatgtgtcaagtatatgggttgtctgtatagaaaaaatacaccacaatagacagacatacagacagagtctttgggcaacactatcaacagcaaagcttcaaagtcagggcaaacagaaagcagaaactaggcagaggaaactcacaaacagatgagtttgctattgagtcatgtgattaggctggtcctaaaacaggctacacaatactgcctagagtgggagaaatatgataggagttcctatcctaatcaggctatagactatctaacaatattatgaaaatgaaacatcaattgagggtttgtctgaatgtctgattccatttcaaaggcagtttatagttataatgagtatcatgcaacatgacatttatatatccttggaatttatcaaagaaatgtaagatatttattttgttttcttccactgaaactttgatcttttgaatttactcctacaggtaaaatccttgtccagttttgcacagagatagaagccatgaagccaggctagttgaagtaagtcaggcctatgaattgaactgaccctatcttgtatatgagtttcaataactgggctactttccctccttccatataagcaagcaccattctgaccattaatttcaggagccctttcctgctcttgtctctcaggcctaaatccttttctcagttactaaaaagaatccatctaatgccgaggtcttttctcttcagaccaaccactaactgcctacctctcaggacttgactctatttttttttctgatgttgctggtatgttagtctggtcttttattaattaatcaagtgagctttttcttcccattatattcttataattgtgtctggtctttagtctctctggcatttctctgacctctctcactgtcctggaaccatgtggaaaataccatgccatctctaacatttgcattcttcattgcacatggttcaggccacagcctgtgtttgataaatactaattagctggataaggaactaagtcatgatgccaagttgcaggattattaaattataattgtaaaaattacatttttaaaataaaatgagtgaggcagacacagtacccttaagcctagtgaatatgatgtttgatgctagttatacatgtgatagtgctgtatgctctcatgaaaggtatttctgaaagtttattttaccattttcctcctttttaatcttaattttatcattcattctcctcactgtattatttttctgtatttttctcaatgttctcattttccaattttccttattctttaatgtcaatgtgctattttgtattgtattttcctctgtattagttcgtttcaagacttttctccttttattcaaaactcttaaccaacatcatttagtctggcacagcatagtgagctcagcaaatataaaagtaaataaataaacaaacctgtgccaattttctggttgaaatctgaaaaaatattactcaaaaggttgactctctattattaaaggcatgacattaaataagaattatgtttacaacataggaactttacctgctgaagttggttcttcttcatctgatgctatgataagaggaaaaggtgaaatgggggtggggtagaagtgaagggagggagaaggggggagagagaaagaaagagaaaaagagatattgagattgaacataaatatatttcacatttccaaacactaactacaagcccctgacttgtaattttgtgtatacattagaaaattgtcatgatttaataacagattaatgagtattcacattaaataaaaacatatgtgctcctatactttaaaatatctattaatatttgttagaaaaaaattgaattgtctgaatttgattttcctttgcaaataagattaaccttagttaatttgagtataaattattataaatattgctgctgaaaaatatggattgtatataacatagagctaccccaccatcaattttctatttggcaaagaggaattaaaagtcatggctgatggtcaaaaattgtgttccatgagatagaagttataagaaaggaagaattaaacttcagggtgactcaaaatcactttggacttttctttttttttttttttagatggagtttcactcttgttgcccaggctggagtgcaatggcacaatctcggctcactgcaacctccgcctcctgggttcaagcaattctcctgtctcagcctcctgagtagctgggattacaggcatgtaccaccacacctggctaatgttgtacttttagtagagatggagtttctccatgttggtcaggctggtcttgaactcctgacctcaggtgatccgcctgcctgggcctcccaaagtgctgggattacaggcatgagccaccgaacccggcctggacttttcttaaacatgaagattccagttctctctctctctctcccactacgtgatgtgtgtgtgtgtgtgtgtgtgtgtgtgtgtgtgtgacatacacacacttacatataccacacacttcaaaatttagtagtgatgattctgtggtaaggacaccggaacctgcattttaaagagtgaccccaggtggttctgacttatgttctgcaacccacatatggatacacatagacattataaaagaggaggccacaatacgaaaatacaattttatccttgggtagtggttaccaaccctgtaagtatattagaattccaaattctgggctccacatagaaccaattaagtcagaatctttacatggtattaacttgtagccaggattgaggtattactaggcaatatcaatgtaagataacattaactgtaactcatacaagtgtgaatcttgttgattcctgttttaagaggtaggaaggtttgagagcagcaagattccaagggcaataacctactgccctgtgtatgtggaggatggagcacagcaattacaagagtgaaaaagaagtttgtctgaagcagcttcacaattttgcctagaatccatctattcacttttatacttcaacacacactctgtgaagaagtatttctgctctgtacagaactgcagtttacccagaatattaccgttgaattatatgacacaagccagtcctatttcacttgattcatgaagttttaaaataaaaatttactcagctgaattgcttataaaggaactttgttcccagcggattcgttaatcaaggtatcactgtgtagccagggagtggtctccactcttttccgttaaggttacatctgcgcagagtacacattagacaagctgactttgtgtcctgacagtgttttcttctcacactgtttggctcgcctccttggcacataaagaaatggagagagcaaacacagttggcatgcatggcgcagagaacataaatattttaaaagctgtttgccgctttatcatgtccaaaatatatcataacatgttcaaagaggaaaaaaaatggtagcttccaggaattcccttttaggaaaataccacaggggcttgcagaagtgctgacttagatgagttattgttaacaaaatctagagattcaaaagaaaaaaaatccttacacttatggctggtcactttatgtgtatgaactcatttaattcacaaagcaaccaatgagatgaaaatatttctcatttgataaaagaaagtacagaggttcagagtgactgaacaatctgtgtgagttcaatttgaatttgagctcatgtcagtgtgactttaaaactgaacttcttctgctgtgccttattgtatcacaaagtgctgattccgtttctacttaaagataaaaactagacggcagagtttaccgaaattcactaggtactatttaaagtgttgggtcatgggagtagttatgctcctaataatgttagctggacttaagcataaaactgggggagaaaagaaagaaaaattgatacagaggctgaggagagaaatcctttcaagaaatggagttctttggaagcttctccatttcccttacaatccagggacagacataggcagctgagatcctgactggttaaacaaagcaccctaaagaagtgatgtctaagaaggaagactggaagttgctaagattttacttttccattatgtaagaacaagcaagaaattttaggaaggaattagcaagtacagaaatgaagacaattccaaatttagtaagagtcatagtaatcagaacctttgaaaaagcaaatcccacagggcaagctgtgcaccaatctacacttgaatttgcaatacctgaaagtatctttgttacaaattaacagaattacagccagcaaatacacaactttgcaaagatttctctatgtaacatctacatagcagtgcttccttgatatgggtagatgtcattaaccaatattcatactattcacactcatgaaggcatatacacaagggttactattggtaataatccagctttagttatctctgtaacaaaggcagcatttcaggctaactgctttactgaacaaaacatcatcaactattaacaggtggcaactagagccccagagtaaaaataaacctcaaagtgggcattagttgccttattaatgacatttctgcgaaacaagtatcacagaaggtactatcatgctacccaaatgattattctctcttcctctcagaagtcataaaatcagcaattaaaataaaaatcagagtctatggcacatgtagtctcttctaattctgggaatttaaacacattcaccaagaaaaccaaaaataagcaacccaacaaataagtgtattgctccacttggtcagcatttagaagaatgtactgaaattataatgatggtaggaaaacagaggtaaaaaaatatatcagacatatagaatttaagtaagtgtaatcctcctatcacccataacagaatcttcctgggtgtctgttaaaatgccccacacctactgaatttgaatattgggttttagcccaggcttctgcattttttataagttctgtagataatcgccacgaacactaaatattgagaattctgactctaacccatcaaagtttatttcactgggaaacagccatgggtaccattgttggaaccacagcagtaaattagtaggcttacagaaaaccctttgcaatttatattccggttgtttcacgagatttcaacactgttttcttgtatcatcttcagatttcattgggtatctatatcaatgctttagggaaagatgacatcccctttggatttaataaatggtctgtatctcagaactaactaaatctgttcccttttcttggccacagttattggcctagatataggcatgtgacccatttggggacaaggatatgtaaggagatatttgtgtgtatttaggtggggagaggctcttggaaaaaaaaggcctcctcactcttctcagaaagtgtctggaaataaccccttctcactctcctttagatgtagacacagaggcttgtggccccagaagtcattggcatgcaccttgcaaccatgatgggagacagatctggaagaaagctgatcctgctcaaaggcagagtgcagaaacaaagattttagaatcttgatgagattgttgagccactgaatcatatcaaccatgaatcctgacctttctttggacttctagttctagggaaaatacatactgtgtattatttgagttgagctttttgttatttacatctaaatggcaatctgctacaatcctaatcagttttgttgttccttttaaaaatattagaatgcataagaaattaattatctgaggcagctgagaccagaagtacacacagcctcaggctatgcattcagtgggcagctgagatttcagtgctttatttttccagggagcttaccaccatgctttgatacaataaacctattccttgatttttaagttagtcgctcttttgcaggacattccaccagtgtacatgttcccatgttcctgaagtgtggtggtacttgggaggacaggaaggcatcatacagactctccttgacttccttcctttcttcctcactctctttctctttttccccacaagtatcaactgtgaagtacaactacccaggcccagtgggccgtatattaccctgatacaacacgatactataacacttaagtttattcattagacagattccagtctctttgtgtggtttcaacaattcttacatattctgtttttgtctgtttcatttttgagtgttttaagtaaacttttataacttggaaattatacccattaaaaacaattttacacccagtgtggcttaccatcaaataggaaaatctcattatgaaatataaaaactacatttcttagtatattataacatattttacatgtgaatgttaattcagagtgacttattgatccttttgttggctatatcataaatttggttaagcatgtaccaaatatgttttcaagcatataattatctagtcattagttatttccataacaagaactatgtattattgtattctgacaatattttacaatgttttattcaactgcagtgatgcaaaaatagcaatcatgatatttatgcttgattatttatgcctacccagatgtcaagtgctctacatgtgtgtgtatgtttgtgtgttgagggaagcagaggcattactaaaattagagtaaactattatttaaatttgtgaactcagtcattaaagaaggatatggagttgcctgcggacgtatccatagaagtactgagagagaggtttgggttaatttggtttttgttttattatttgtttatctgttgtccttggccaatggcccaactgggatatgactttgtacttaaaggttgctattactaacttcttccctgtgaaaagtataacaaagatgattagtttcctctggccaaatatttcagacagcatatgatgtggtcaactccacaatctcagaactgcagagtatttgggtcactgtgaggcacagcattggatttgcatagaaaatgcttgaataatcaaaatgtttccattctatcaacattttacatgcattgtgattcctgtgcaaaatttggagaatggcatccattgaagtattgataatatataacacataaaacataattttgtacacatgtagttagcatgtaaacatatattgaatttttattagtctctcccattagactaagagtttcatgaggacagggctgtagcatttttttgctcaccattacatccgtagttttcaaaacagtgtctggaacactggaggaactgaataaatatttgttgaaagaaaagatacacaaatgtttaatacagtcatttgtattaaataaagctcagctgcttcattttgtaatattattaaattaatcaaagaaagccttacatctctgtatatgtttcatcatataaatatatacataattatatatagtttctatagctatatgtcattatataaatcagattttccttcttggggtaggaaggaaacaatataattattataaagacaatggttgctctaaagaccattagattatctcatgaaaaattaaatctgtgatttttaaactaactcagaaaacatgaaactatgatttattaattaagtagattcatttaaacagaaccacaaaatgtacttttaatgtttagtggtgatatagtttacatgggttttacaatgtatttatacagtgaatcattttaacagcaattaccagtgcatttgtgattctctcattttagaaagaggtataaatgagaaaaataacaaaaaagaatgcaagctttgggttcaatttttgccactgagtaagaaaactaaaactaaactgaacaaaaacacgtattttataaaagtaagccagagtactgggaagctggaaagtaatatgactcaaatagcctacattcatatcccagctgttattagtctttgagaacataattaggacaaattctcttacttaaaggaagtagtaaatatctttaagttaggtgatttgatataataaggggacttacaattcaatattttggtgtatctattcaattgtccttaaatatcctttgtttattaaatgtgcccttcctccctatccaaacccaaaccatccttgtcgactgaattcaagtttcaccaccttcaactccttagtatttatttcagtctccagatattcccttctaaccccactaccttttaaactataaccgaaagccagttctaaacagaatggtacataatattttccagctttgtttcccaagctggacattattcttccttggagggcaaatgttttaattttgcacagtgtatataattggttctgagtaaatatttttggaaagttgtccaattttaaattgagaaaatgaagtccaaaagtaaatttaatgactgtttttaccctttttttttttagctttgtaaaatgaggattgaaaattaaacctaagaaaattcatgggcaaataaaacgaagaaacttgtaagggataaagcagatcaaaagttaatataaatgatttctcagatttatccattttcaataaaattaataaattcataatctttttgaaaatttaatacaggaaagagagaatcattaattctacaatgagaatgctgtttaatgtcactagagaagccatgaagccgaggctaccagctcactagatatgaatttcagatggtcacagcatccatgttattttgtttcatagcacctgacagcaggaagctgatactctcaggctcctttatgttctatggatttctgctttatttatgtgtgggagactactcacttcaacctcaattcatttccctaagtctggacaaatgagctaatctaaaaagcaaatctgctaaaaccaaaagaacagaaaactaaaaagtaatgaattgatcagcaatactggcacaaatctcagtgacagtatccacttaagaaaaccacagaatcattgcacataaaatgttaatgctggacaagacttaatgattaagagtgttgtcaaaaaaaaatccattggtacaatgggttaaggtttgcattagaaaatagaagtatatttattaaatcacctaaattactaactaaaattcaccacaagcagaattttgaagtaaatggatatggcataatttgtttcactaagtctttagtgaataatacttggatgaattccaggacttctgtcttataaatgaggtttcaatgaataatcagatttcatttgaatcatggtagaaacaaagaaaataaattatctaatacttttattaaataaagtccataatcctaaacacaatgtaaaatatttgctttttgtaagaaagatttttaaaagatcctctttgatgccatcctttttgatgccatcagcctattttttaaaaaaaggactatgcttcttaaatatattggatgatattatatttctgccattttcctgtgaatgttactctcttgctttaataaagttaccattaacagagatatagtaaaacttccaatgtctgatgtccaatagcacaaaacacagagacaaacaaatgactgatccatgtgcctggcagatgcagccttagaccaattactggtttccctgcccatcatcccaccccagtagagatgcttagggctgaatactgaatattctgtgtcttctgagatataaataatataaaacttcaatgcttttaaaaaataaatggtgatgaatttaaagatagaaaattacttcatggtagaatcttggcaaacggtgtgtgtgtgtgtgtatgtgtgtgtgtgtcacaaccaagtatttcatatggttacagttatttcaaacatgactttttaccattttaatatctgtgaggtcttttagtaaaatatcattgccttttcattgcttatattccaaaataattcagaaattttacaatggctttgaaatgatgtgttcccaaaatatagatcgacacatttggcttaattaaaatatattttgaaattcaaaagatgaagggggaagaaaaaaaaacagtgggcaggtctaacttgaagaaagatgagatatttccgtgaaatctgtacgtgtcattttggtcagggggagttatctttttcatgtagttttaactcatctcaaggacactaaccataagaaataaagcacaatttctgcttgattacgtagagctaatctaatgtgctactgcctttatgtaacagtgagttaatgactgctttagaggattttttttcttcctgttacaacaggagctaaaattaaatgttttttttttttttttttcagaatcattaggaccttcttgaaaggaaaatagtgtatccacatttgggtgttaatcatataacattgacaatgtaattttcttatctgcaaaacttgtctccctaggctaaatttctccttaattgggatgtctttaaagaactcaactgataaaaaagtagacaggcctaactttaaggcaatgaaaattgaataaaggtgcaggactattcagggtgggcccacaccacatttttctaatcttttagaatattttcaagtcttgaatgcaaactattaatttctacccttctaacagatccaatctgcggaccaaaaaatctatatatctttcaaaatttctagaggcagggaactcaaaatctcatcaaggaacatgtcatatctctctcccagagctcacctctagaaaacaatggactaatgaggcccattctttgacaggccagtcattcaaatatttaaaagctattgtaattcttttcttaactgagataaatatccctacttaattttacatattatggtatatacaccctagtcatcatttttgttgacctactcttgataaactcaaatttgataacgtattttaaaatatagtaatgagaatggaaacagtactccagatgtgatctaactagcacaaaatacaatggtgttattacctgtcttgtttaggcggctttataacaaccagcaatccaacattgtaaagaattaatttcctttccttccctccttcagctacatcttttttttttaattatattttaagttctggggtacatatgcacaatgtgcaggtttgttacatatgtatacatgtgccagcacatgtatgtttattgcggcactattcacaatagcaaaaacttggaaccttcagctacatcttatggaccaattcctagagtactgggaactggtaatcttatcttcttgctgcctaaaggcaagattagtcagaggaggtcatgcttggggttgagtcaagggagaatataactggcatgcaaacaatgtcaaaggtatctttgcaacgggaaagaattgcaaaattttgcaacaaagaaaagccttaaagacatactttcaatctttcactttctctctagcaaagaatctagtttgcatatatttcacatgtagttgattaaagtccacagacaggaaaaccaaacatttgttctaatggaaacaatttccttagtgtccaaaactagtgtccatccagcagaatataaatattttgtagtttctcatgaaattttccatgtcaactgacatttctagttgtagatgtttctcctggaaaccagctttaaaagtttacagctgtttcttccaataactaatttctggttagaaattctagattaaaacttagcatcaatttcagtcaatgagccacattcagccctttccaaatcaactacctattagaccaagtcctgtcaaaaataaaataattaataaatcaaaaaataaatttatcttggaggcagaataaaactgtaatagaaaaatgtacaatttaaacaatgtaatcctcaaaagaaaagcctgaggtagtacttaaatgctgttcagataagagctttgtgttcttttgtttttatgattacacacttgaataatatattatcaagggaagttatagagtcatatttctgggataattttggaaataacattgaagactatattttggttcaaggagatgaatagaggctctatatccagggtctccaacttccatggggcatgaaccggtatgggtccctggcctgttagaaacccggctgcacaacaggaaatgagcctgagccccgcctcctctcagatcagcagcagcattagattctcataggagcaggaaccctattgtgagcatgcctatgtgggttatctagggtgtggcctccttaatctaatgcctgatgatctgaggtggaacagtttcatcctgaaactattccccaaccaccggtccatggaaaaaattgtcttccacgaaactggttcctggtgccaaaaaggttggggaccgcagctctatggaatacagatccacattaccttcctggtcttgctcccaatcctccccataaacaccttataaactgagcaaccactaatgctaattcttctagaaagtttccccatgtctcctattaaaacaccttataaactgagcaaccactaatgctaattcttctagaaagtttccccatgtctcctgtttttctaattttttatcattctatatttgcttaaaatgttccaatatcataatgtctacagattaaataaatttccatctcagctcatctcacaaaagccaccacaaccataaaatctgattcctaggacaggaagtgatctttccccacttgatacccatagcactttgttcccctcttatgataattattttctgcattgtataatgattactgatatgcctgtcttaccctttctcaaatgtaagtatttaaaaggcagagtctttatcatcaggtcatagagaaagggtagatcacaggctctccatgaaggctcaatacacatttgttaaatggaagatcctaatgttcttttttccctatgattctatctttatgcaaaaccacaaaaagcttattgttgatctatcatatccaagaaactaatattaatgtgctatcataaattccaacttggtatttattatacctttacaggattcccattttgcaatcttataaataaaaaaatcaattcataacttatttgctctaagcataaggaaggctagattcctaaaggactgattcctaattatgcaagccttacctacattactcataaatttcatataataaaaaatagggctctctttttcccatatgaaatgaagtgatttgtcaaattatatgttgaaggaaataaattttttgaaaaattaaaagctgacaactaaattgcccccagtttgtgtattcatgcaccaacaggaaaaaaaaaaaacaacctgacataaaaataataagtcagtacttattggacatttcaataattttattaatgactaaaatgatgaaagaatagtcagaggcctagatgtttgatttctgcatgtagctttaaaatagtatataaggtttaattatttatatcacttaattagtaactcctgggtggcacttatgagccagacactgttttaagatccttacatatattgaatcatttaatttatacaaaagcagccgggcgcggtggctcacgcctgtaatcccagcactttgacaggccgaggtgggcagatcacgaagtcaggagatcgagaccatcctggctaaaacagtgaaaccccgtctctactaaaagtacaaaaaaaaaaaaaaaaaattagccaggcgtggtggtgggcgcctgtagtcccagctactcgggaggctgaggcaggagaatggcgtgaacctgggaggcggagcttgcagtgagccgagatcacgccactgcactccagcctgcgcggcagagcgagactctgtctcaaaaaaaaaaaaaatttacacaaaaaccctttgaagttggtactgttaaccccagttttacagatgaggaaagtaaggtggagagagattaagtaacttgctcaaagtcacagacttagcaaacagaagtaccaagatttcaactcagcctggctagcttcttaaccacacccccatgatgctgtccttgaaagaatgtgttccttcagatatttacacactacagaattccagtagagcatgctcagcatgtaagaaacactggaattagaagtattatttttggctaggtgctgtggctcatgcctgtaatctcaacatttcgggaggctgaggtgggcggattgcttgagcccagaagttcaagatcagcctgggcgacatggcaaaaccctgtctctacacaaagtacaaaaactaaccaggcttggtggagtgtacctgtagtcccagctacttgggaggctgaggtgggaagatcacttgagccccggacattgaggctgcagtgagccatgattgcatcattgcactccagcataggcgacagagaccctatcttaaaaaaaaaaaaaaaaaaacttccaaagaaatattattattattatttcttcgagtttgaaagtaaccctccccatatgtgtaacaggcacagcttaatttgaacacaagcactgcagtgtgcaaaaagcatggaacaaaattgtaggtttaacacctgttcttccactgagcaggaatcaatgaccttggtctaatcattacatttatcacagaatccccttcccgtttaacactgacattgatattagctcccttgtttattttcaggttattttatgtgtgtgtgtgtgtgtgtaaatgaatggtgcactctgaaaatacaggcaaaattaaagggaaaagggtgaggaaaaaagtctttgtctttggcattacagtgaccgataaactgcatacaaagactatctgcccacacacttcagtgtttatcacctgatgtcctaataaccagcagggctcattgagaagtgagctttactacggtagttgtgggacaggaaagcattgtggaaagtaatacagctggacctccatatttaagaagtaatgaaatctaaccttggaagccagaggctgtgctgtgatgcactccaatttatctattgcctgaagagccaaagtcattggttaaaagatagctaagttgacacaaacagcatgtgtcttgttcttgaaaatgtttgtagctccttgtgtagatgagtaacaataatgagttctgtgtccagtggctccctgtgatttggatgaagcacttctggtttgatttcacaatgaaaccttagcagataaagacattgtggggttatatgaacacattgtattaaaaaggtgttaattcttatttgaaatttgctatattttccaaggattagtacgtaagaaaacaaatatctttactgggttctatctctggctgagagatggaaattttgccctccctatttttctttccaggccttgattaaaataaaaagaagataacaataaatattgattgttgtctattttaaatcatagcttggttaattttatactctcaaaggccaaaattaaatataatctggaaatgattcagcccaattctactctcattatatgactcatttaaaaattgttacccatgtactttaagcatatggattatggaattttcttcacataaatactttgatatatgttaaacaataagttgtcttacagtacaaagtcaccttgagatgtaacctagtttttctatggctccggggaatgtggccaaacaaaactccagaaacgatgacatctactttaagctctttaacaaagaatccatgcctctatttcatctcagtaacccttatgctttattgtagtaattcctcatatcaaatagcatgattctagcacataggagataccaataagatttgtattagatgttacagcaggagtctgtaaaattttcaagaaattaatccaacctatcaaaacacttatgtatttatttacttatttagttagtttgaagcagtctctctcttttgccaggttggagtacagtggcatgatctcaactcactgcaacctctgcctcccaggttcaagcaattctcatttcagcctcctgagtagcggggattacaggtgtgcaccaccacacctggctattttttttttttttttgtatttttagtagagaaaagcttttaccatgttggccaggctggtcttaaacccctgaactcaagtgaactgcccgccttggtctcccaaagtactgggattacaggcatgagccactgctccaggccaaaacatttattttcaatgaattcttaaagtgtcatatctttgtcttcattctatcttctgtgttactagtagtatgaggaaagatgagaacaaaggctgtgtcattcatccgttagccctttactttctttgtccacttaccctaagctttctttgtccacttaccctaagcctgttccatactttagattggggtcctaccagtccgtggcctgttatgaaccaggcagtaggtgaaagagcatcactgcatgagctccgcctcccgtcagatcagcagcagcattaaattctcataagaacacaaactattgtgaactgcatatgcaagggatgtaggttgcgtgctccttatgagaatctaatgccaacccaccttctgtggcaaaattgtctttcatgaaacccagtccttggtaccaaagaggatggggactgctgctgtagatgctctaaaacatgatttaagctttctttgattaaatgcttattccttctctcattggtcttgattttagagaatgtccctttctttatagtttttattaactaaactcttcactcttctttatatacgcctagttctagtttacccttttttaaatgttttatggcctactacagtaatcaaatgtttgaatgaaaattaaaggagatataatcacattatttaaaaaatatatttgataggacaacaatctcttctttttctcttcatgtgtatttttcttttcctattatacaaatcaaataactccaaatctatattactatgaataagtgagcataagtccattaagcttcctcttcattataaatctcaatttctctgatgataacatttcaacaccttgtcataactgcttaaaagttaatgttttttaaatgacttgctttatttggataccatagtttatggtgcaaataacttaatctaaaggaaataacaataggtataatttcctagaataaagaaatagattcatgttgaaaatcaatgaagaagatgaaatcaagtaacagaatgaaagattgtaaagatttttggcatgttttacatagtatcatataagtgatttgtgagtcttctatagattgcttttccatgaaagggaaaagctggaagataaaatctttccagagattaatgctaaatttgccactgtggcctatcactttgaatttgtaattttcattttcataagtgtatagaattatatattttggctgtgccacaagtgatttcaggttaggagtaaaagggcaatttgatattaccttcaattttcaccttcctattttttcaataattttttctaaaatgtaaaaaaaaaaaaaaaaaaatctaagtttttccttaagagattttacctttttactccttataaaaataattgaagagcttttgctaaagccaatgtgattaggatttgtgtaatcatggccatatatttgtgtataacgtaaaaagaaatatctgcaaacatacctatgtgtttatcaacttgttgctttgccaataaaactcttcaaaaataaaattaaaaagagaagcaacattccacagcagattgtaaaactagccacaaactcctccccttcttgcatccgcacatttgtaaaatgaaattgcatatattcccctcaaaagtgttgttagctactgtgaggcaagccgagatttgaaaagtgccttttaggactcgatctttcttactactcttgacacctttgccactgccactacgtaatagtagagatcagttaaccatcttctatccagcgccagctgactgcagacgcagatatgagtgcaacaaagacgtaaaagatgttccagagatgaatatccacttagctgtctcacacacttctgagataatatgattattttttaataaatccattaaactctgtgattatttgttaggcagtaaaatacattcaaatacaaaagcagttattccctatgaataaggacatactcctagaagaaaggacagtggtttaaatgacatacatcaatttcttaatgggtcattgtcttttcttacaaataaaagctttaccacaaactggcttttaccctttgactgggctagagtggcttttggtactcaataatatctaaggttctttgatgttatacatttttttctttctgaaagttaacatataattgtcacagcttggaattgcaaactaacaaattctaatcattgtcattattaataaagcagaaatatttttacatcaataagctaatgagtttatatggtatgttacagaatttttacacatataaaatataattacttttccataatatatgcaaaattagtacgaaaactttcccttaattatctgtcatcttaactgcacaattatatttgtttgtatgaacttatatttaccctttcttattattagaaaagtaagtaaacataactgtgaaaataaatccctttgaccctagttgactggaaaatttcttagcaatcatctattggctagcagctttagagaaagtattttagtccgtgaaacatagctctcattatggtaacttctagaaaaatggattcaatcatgagtctaagaagtaatcttaagtagaggggaaaataaaccaccccgacaactactcacaatttcatctactatctgaaaaatttaactgaaatttaccaaatccctcatttggtaaccaaagtctcgaaatctaaaataaccctacaccacccaagagagctacttaaggctcgttaactttctgatatttcatgaacactaacaagaagtctttcggacaacgtcagactctattatactacttgatattctgacactgattgccttctgaaagataaacatgaatatggctattcatagagtgaaatgtacagtcaacttctagttttttaaaaaatgtgtatgacagtctgtattttctgggataaatatattcaatttttcataataaaatgaaagctgaggaacagattattagtgacaatataggagggtaacacatttaatagaatctgaatttgtggtagaaaagggatatcattaccaaagggaaataagtttctatggaatatgataggtaaaagaggataagagaagataaaacagaataaaataacttttcctgaatatatatatgtattttttacatgatatgctatacatatatatatttggaaatgagaagcctggccagatgtcaatgtaattacagagaagataaaaagaaattataaataaaataatatacagtactattatcctgtactgacctactgtcaataatacacatacttttaattttttccaagtgataatgaatcttatattactaccaaattccaatgtttatattctttgttttgtctgatcattttaacaatattttacacatatttacgacaaagaccattttttaactgctatatcctcagtgccaggaagagtggcacatagctgatactcaaatatttgatagatgaatgagtaagcaaataaataaatagacaaatgtttgttttagccatttaatttttttctacaaattcttctacgtgccacagtcaagctctttctccacaacgccagcaaaactaatcttccgtaaaccaacaagatcatccatcaatcacatgtaatcaaaggaaatgcttatcttgcttaactgctccacagtacttgacactgctgattacccactccttgagacattgttaatcctgaacttactgtgcaccacactttcctggttttccttctacctgactactctgcctctctggctcctttacagatttcactttctctgcctatcacttaaatattgatggcctcttaccgctttgtatttctaattcctctattctttcccatgtctagctcttctattctttgctattatcctgtttctagacagactcatccattccctaagcttcaataaccatctatgtaattatgacttctacatctatgcttgacttcttagataatgtctatcaaatttgtcaaattcaacatgtgaaatactgaactctccttctgcctcccaatcctgtgtattgtcatttataatatctcagtaaatgatacccagttgctcaggccagaaactggggatgcctttctttactcttagtttctcccaaactctttttcttcataccccataaataagcaataattgtctatggtatcatctaaatactcagtgactctctcctcttcatcccgttagttaccacattgacagaagccaagatcatcatgtctagcctcatctgctgcaattgccttcaaattgtccccctgctgtattttgctgtaatttgttttccatattgcaccaacagaaatacaaaatctcttgtttttcttagtaaaaagttgaaatttttttaaacactgtaccaaactctagagtatctgccacttgtcaccatcctcagagtcagtgctggccaccatgtcccttctctctaagttttagccacatttaacttctttcagtttatgacattatacctttttttttaatctcctggttattctacacactattttctctgtctggaataggttttgttgtttgttgtagtttttagtctgcaatagattgaaattattttttagatttatgtctagatgttactttttcaggttggcatgcattcctttacacttagcttaaagcaagacatctgctttatatttttatggctccaggtacttgtatcacaacacataacaacatatctttctatctatctatctatctatctatctatctatctatctatctatctatctatcatctatttttctatctattatctatctccatctttctgtctgtatgtatgtctgtctgtctatctatttgtctcatcatctaaacagcaacttgtttatcattgcccctccaccattcaagtaactattacttagtaaacactcaataaatatttgtttgaaaataaatgaaaactaagattttatttgtttaaaaaaagtcacttattttttccctttgattacgttaatatactatgtatttgagttgtaaaagtttatactttttactagtttaatggattactctgataacacacataggatagttatgccacagaacttgtacaatttaaaaattctcaagatttccatttatgaactgtataatatatactgataggctgggagaggtggctcatgcctgtaatcccagcactttgggagccaaggtgggtggatcacctgaggtcaggagttggagaccagtctggccatatatatatatggaaagagataatagaacatttatatatatatagagagagagataatagaaaatttctgcatgaaatgaatgtgtcataatatagctcccaattacacagtgccatccaggaatgtgagtgagtaattgggaagcaatttgcggcttagccacatggtggtctgtccacaaatcctctggagagggaggcagcattcagtgcacatctgtgcaaacactggttaatctgggtaatgccttcgaattcaagaatttaaaacaagggctttttctttgctttgtttgaagagaagttttcctactgccattttcagatatcagaagtgaatcttaataactctaagaggctgagcacattgagttgtgtaggtgtgtgatagctgtgtgtggggatacagagaggcagagagagagagagaatgagaatgcagtatacagaaatatcaaaaaatgtccagagaaaagcaatgttgtctagtgaaggaagttcacaaatctgagaaagtcaattctgccaaactatcctacgtaacacaggaatgcaagtgatgtgagtattgattgcaaatgtgttaagtgttttgtgcttatctgacattatatgctttgtgagggaagaataaaagtacaaaactggatgaggatcgcttgaaataaatatcaacaacctgaaacaaagctactgcaaagtagtaaggtttgaggtaaaatcatgaaatgtttttctctaagcatgcatttgaaattctcctttccagatgaactgcaatgaaaagagtatgtgtctgactgtagaataaacaggataaacataattttaaaaactgggatcaaaaaacaactttttctaagcaaatataaatgagattattttctttcctttggaaattaaaaatataaagattcagaatttcataatatatatggctcaaaattcatatggtctgaaatggatagaagaaaccttagacacatctctatctttgtggtaactaatatgtaaggaaaaatacagactagtgacagctcaaatattttttgtcttttaagatattacctcaaaatacccacatgtgttttttgtttgtttgttttttaaattccaatacactctgtttcctgcattggtgctagataacaacaggagaacaataacaaaaaagccttggccaagccatttatttttatttttatttatatatttatttatttgagatggagtctctctctgtcacctaggctggaatgcagtggcacaatctcagctcattgcaacctctgcctcctgggttcaagtgattctcctgcctcagcctccctagtagctgggactacaggaacctgttattgtgcccggttaatttttgtatatttggtagagacagggtttcactatgttggccaggctggtctcaaactcctgacttcgtgatccgcccacctcggccttccaaagtgctgggattaccgaccagcgtgagccaccacgcccggcctttttttttttttcgaaacaaaaacgcaggatggtctttagtaatctaatgtttgaaatatttgatcccaatattagttttaaaaatatgaaaagacccaaggtaagctagatattaaaggcattactaccaagtattactatgcaatcaatatttagtacacctttcatatgcaagaaaatatgaagctaagaaaaagcagtagaaaggcaatagggtaatgtttctgtcataaataggtattgaacttgaaaactgtgcttgatttctcattattttctgatcctttataaaaattacgtcataatataggaaagttgtattcaagaaactgtcaacactttaagactttaggaaagttttttcctagtattttaatgttagaacaccagcacatgaaaatagaattggtgtaactaatatcctatactaaatgatcaaacaaatacaaactaaatacatttcttccaaaaactcctaaatacagcccagagaagaatagggttgtatgaaatgtataattaaaaaatatagcttaaaataatacagtataactatccaatttctgaatatcagagatgtatactaatatgtaataatgaatctgagtagaatttaattctataagcgtttaatttcccaaagtcacactgaactaggtgggatatggcagcgtgcttagtttttaaagtgttgctgcccatagtatcagtcttcagataaaatgttgaatgttggattaatatttaaaagtatagcccaaaagtatacaagtatttactttaaaattcggctggccgggcgcggtcgctcacgcctgtaatcccaacactttgggaggccgaggtgggtggatcacgagctcaggaaatcgagatcatcctggctaacacagtgaaaccccgtctgtactaaaaatacaaaaagaaattagccgggcgtggcggcaggcgcctgtagtcccagcttctccggaggctgaggcaggagaacggtgtgaacccggggtgcggagcttgcagcgagctgagatcgtgccagtgcaccccagcctgtgcgacaaagtgagactccgtctcaaaaaaaaaaaaaaaaaaaaaaaaattctgctaagatactgatttcttaatcatttacctacatttgtttctctgattccagatttggatctttcaaatagtgccaaaaatattatatactattatacaactcgaaggcactgccaatttggggttgttgggcttaaaatacaacactaaaattttactctattcatacatttctactaggggtatttatgactctaattttcttcagatatacagactttcctgaggatatgattctcacattaaactctgaaactcaaatgtacatatttgaagcctgggtcaaagtggttacaacagttttatttcgatggcactgtgtcaaacctcctaaaatatcagtgagttaataaaagcattaaaagagaattatctttgaagatgaattaaatgaacaaagtacctttcagcaataataaacttctttagataacatatattcataatgcaatataaaaaataaggaaaattcattaaaaaaataaagcacactacaatccagtaactaatggccaaagatggtaaattaatggttttatttaattattctttctttcattcaaccaatagttactggatttttactatgcataaggtaattaagttaggtgcactgggtacaatgatgggtaattcagactgatccctggacgctattacttttctttttcaaaactatttccccaaagccattgaagtgtcctgtttctctaaggtttatgcaggttgacaaaacatgtttggtttcctataatgaacagatatattccatcttgtactcttcgtggtactaatgcgaaaaatataaatttttttcaaacttacctgtgctattaactttgaaaattatttctctctttagttagagagaaaatctctgcacaagtttacatggtgttaaattattttaaagtacagctatttccttaatggggacctatgtggaaattacagaagttactctaaatccataagtatacatatttcgcagattttttaaaaaactatttgaatgtaaccaatgacacattaatttttgcagagcaaattttttagaaaactttgaagagcactgcatctggaatatcctcttctttatatgcttagaaatataaaatatatttatcacctaagaaaagtaatgattagaacagctacaaaatgctgatggatattcgaagtccctaaaaacatcctgttttatttacagtgataatttaacttgaataaattgactttggagttatgtattttatttgagaataaaatgttaaatttatattaatattagaaatataagaaatgttatatttatgtattatttgtaatgtctttaaatttagtgttaattactaaaaatattttaaaacttaaagaacacaattaatataatttcaatataaactggaaatgatacaactgagaatcctacacaaaagtaaactaattagcaacatatagcaattttacaactaatctccataatgcaccacagccaaactgccatttattcatggaaataaaaagataactactgaaatacttaaattttgcacttaccaacctccacaacactagaacagttggggtctgtgaagccatctggacactcacaggaaaaggaaccatcagccaatcctggcaaacagatacctccattttcacatggattgggatcacaaatatcacctaaggcataaaaaaaaaccgaaattgacattttttttttgtcttggacattgaaacatactagtttactttgctatggatgttcccttggcaaagtcaaaagtcagggtaatattaagattcacacataagatctgcaagactcatttcaaaccatgtactcaaaaaaaaatactatgtaacatggcaaaaattaaactgcataattcaaacactgcctctgaaagctattggttcagtttggagttccttcataatatgtaaagagaatgttgtctaattggttaataaatattaacctaaatatctgtaatagactagtgtcattaattactctaataaataccttctttatatccacacagtttactctttaactctttaaaggacaggagtttatttctggatccctagaatctgggcttgtccatgtgacttgctttggccagtaggtcgttaacagacttgaagacaacagagatttgaaaagcacttgaagacatctacttcctctcttggagtgctgagatcgtcatgtgaatgaattcaggctagcttgcttgagatgagtgaaagaaatgtggaaggataagaaagaaactgctacagagaaataacttatgacataacagaaaccccacaatacgtggccttggctgtggcaatgggtggcagatagtatctggaaaagcagtcatggccatgaaaagctagaaaaatggctacccattttatgtagtgtgtaacaattgataaagctgtcatctgaggtaactggggaggtagaacatgtatgcgatgaacttttcatatgagtaaggagatttccgggcagactgttaaagcatcagttggctcttactgcctgcatatgataaggtgctacaataaagagatgagctaaataaagaaccagtccatttgaaagtaaagggaagtagtatacaaggaccaggacttgtgttagaaaacacaattgtttctaaactcccaactctcaaagtggtaaattatcgaatgccagaaagacatggcccaacataaatatcaatcatggatgtggctacaaacctccctgtgaaaacatttcaaataattcaggtggagcctgaaagatcttctcagctaaataaaagggcttctagagaccttaaggattgtccctgagaaggctgacacacccaaagtagcactgattaagtctggagtaaaaagcaggcttcagacagaatcatgggtgtggctttattgcacacaggatttgaatcagatgcacaaaaacccatacagttttaaagggagctttgtaggtgaaactgccacctcctggactcaatgagtaagggacttttcaaaataaaaaagcatctgggcaccaacttcctactagtttgtatttcttagttatgttattctctgtaaggtttttcacatgagaattatttaaactcttttccagatgaagcactttaaaaatatttgaaaaatgaaaattcaggttatgatttctgtcaaatataaaccaagtcattagccacactaagatgatagattaaaacagtacctaagtgctggagcagaccttagaaaagagagtcataaaatgaatgaattaatgtttggggaataccaaagaatttagcgtggctggaccatggagtatttaatctggaatggctaagaaagtataaatatgttagatcagggaggattaaaaagtgccattgtaatttttaagataaggaatcaatgagagagtgtctaacatttttaacatgtattttaaagtttggacatggtcagatctaaattaagaagacaatcctggcagcattttgaatggggtgattgatgactgataaagatacttcagtagacttgctatcatttatatacttatcatctaactatctatctatctatctatctatctatcatctatctatctatccatttatccatccacacatatagctagctagctatccttccatttgtctatcaatttgtctatctgtccttctagtccttgagtacctattgcatggtaggcaggcactgaggtaagtgctgtatataccaaactaaataacagactatggagcttagtgggagagataaaaatgcaggaacaattacaattatactacacagtagtaacacctgcaactggtatacatgatccaaactgtgggaccagtggagacttttaaggagactcagtgctatcaggtgatgaagaggagagagcgtatgcttaatattccaggcaaagggaataacacacttaaaggaaaaaggtcatgtctcattccaggaacttcaggtaggccactgtagctagaatataaatacgtattagaaatagaaaatgatgaggtccaaaaggtaggaaggccatatgaatcaaggtcttgtatgctgtgccaaaaattttggagtttatcttcaagcactggaaaattataaaagaacttgaaatatgggaaagtgtatcaccacatttgtgctttggaagaatcactaaggcagcaatgtgttgaatcagatggaggaggttgggccgagggaaaaaggaaaatgcatttattgtttgaagtagtctcaaaaaaaatgatgaagattctcttgacccttcatagaggtggctacagacagggaaatcaaaagaggcatcatttaatatcaaatctagttaataaatactaggtaatgaaaccagaataaaagttcccccaaatcaagacccacccacctatgtggagtaatcagtgtaaggacacagtctcatatttacatatttacctaaaaataagaacccttctttcagatcccactctgtcctataaccaagttcttgcatcagatagtaactgaggtaggcctacagtcctgatatacccagggccaaaggaggttctttcaattatcccatcattatggagagtgccttaagaatcctttctggtgccttaagaaaccttccatggcccctctgctgccctctctagatgataatgctaaatcgagtcaattttctaccaggcatgtgggccagtcatatcatgtttctgtggtcaaaatgagacaggactatctgctcaagtctcattatatcttagagatgccaactgttgtttaactgacatgtttttctctcttctccttgtaatttttgttcttcttttttgcttatggaaacacatttctaatacactcgaaattttcatcttatttccatcattagcatactatcttttgaaagggagaaaacaggtaatagatttgagaaacatgtacaaggtagaatcaagatgatattttgaccaaattgatccaggggttgaggaagagcaaaaaatttgggttgatttccagagctcctgcctggatgattgagtagccatcctttataaggaaatatagtagattcagttttaaagggattattgtatttgaaaagtctgtagaagatctaaaatgaaaatgtccgattaagctattatataagtagatgtagaattaaagagcctctgcttaaacatgacttgttaagtatgaaggttaatactatatttcactgagtctattaagggagggcaggggaagggagtggaggggatgagagcaaagagaaacgaagagaggagaggtccttaggcataccaacaaataagtgaggaaaagatataagattcttcataaaagaaagaagttaatgcttggcccattgtagcccggtataaatgttcagtttattaaactgtggtctaccatgtcaaagtctttctgaaattaataagggccccacatgcaactgtgttgggtggacagtggcaatagaaaccaaagttttgatcttggacaaagtagaggataaacaacaaacataattagggttattatagattttgtttaaaatctgtttctctatacataatcattagtagcatgctttaatcagatgggttctccaagaaggagatgctaagatgaagttaagagcgtaacaagtttattgagaagtaatgtctgcgaatgacaaaatgaggaggaagcagaaatgagcaggaaaagcttcaacttgcgatataggtatgacaccaataaaaataaatgaaagacatgagggtggggatggtcgggacaggattgaccagggagagcctcagtctataatgcagatttgagaaagtcttagtcaatcacacagggagctccagagcaaagattattgttggaaggaattcccctaggtcaggaatgacaggcactagggcaatccaggtagagtgagggcctaaggctcaagtagggtcctgaaagttctgcaggaggctgtcagctaactacatacttgtagctggacagcacattctttcttaaagaaggattagagccgtgcacctccacggggacccacaaacccctctcactctcaaaactgtcctgatttgaatgagttatacggttacttaggtcaaaaccatcatatctcagcctatttcctttatacggccataatctcagtggttagtacagatgtgggttgataccttaagtgaaaacaaactctctcggctagaatttcacatctaattaaaatacacggtagggatttctgatcctctgtaatgtcagtttatccaaggcagtagcacctcaggtaagaaattctgactaaaatgcaataggttcctagactttaaatcaataattgttttctgtttgtttcccagtggatatgttcgtagagtcttttttttttttttttttttttgagacagagtctcgctctgtgcagtggcgcgatctcagctcactgccagctctgtctcccaggttcacgctattctcctgtctcagcctccagagtggctgggactacagtcgcccgccaccatgcccagctaattttctgtatttttagtagagacagggtttcaccatgttagccaggatggtctcgatctcctgacctcatgatctgcctgccttgccctcccaaagtactgagattacaggcgtgagccaccacacctggtctggtaaagtcttttaaaactgcaatgacaaccagtagaagaggttaggctaaggaaaggaaaacagggcaatataagatttcatggttatttatcctactgtcagcaggctcctaaaatatacttctgcatattgtaatgtgtgtagcattatactttgatgtttcttggccggctggcctcacctgcttagattaggacagatgtgtttaatttgattctaaccatgttttatggttccatctgcagtttatggcagattcaggcaaattaagctcatgccgatttgctttttggcaacagaataaagcaattatttttcccaggggcaagaaatcattgcaggctaaatttaacttactgtttgcctgctctttccacccactctccagagttctgatcggactgcatgattctgcatgaaatcaacattgtcttcattcttctcactgacctcctacttgttgccagtcacctcatgttcaaggtgatttaggcactatcttattttacttcattacccatttgcaatccatgaccttttaacctcaacagcaaagtgtgtgagcacctataaaatactacttggtattgcagaagacaatggttaaaaaaaaccgaaaagcctaaaataggtacctttatgattgtggttgtgcattttctgtgagcttagtatataattatacaacttctcatgccatacaaagaagaaaattctatgttggtactactgagaatcaggtagaaaggacagctgattttgttcactgataattaaactcttggatagtttgtgttcaggtttctttatatgttagtgtttgtctccagtacacatatcagagaattactgaatcattaatcacatattcatatgccacaaataaataaggtagcactcactgtaataaaagccatgagaggagggagaaacaggctgatgagaaaaacagcaaataaaactggttatttatgacagacagtgaagcaaggccttcacaagagctgcaaactgaagaatgaactagaatcagtggtgttaaagcctaacgaagagcattctaggcacagggaacaggaagtggtcagccctcatgataggtaagacagagatgatttcaggaacagaaaggaagacaggggaaaaactctcaataagtgtttattgccagcaacacatttttaatagaaactgattgataatttaaagcccaacatttgatcctctgtgttcctggtaatcaagggcaattctactaagcttactctttatatgcagtaaacatctactgaacatatactattgtattaatatttacaggctaatgtacttatgaatttacatgttgaactctttcttacatattaatgtatttacatagtactgttaatgtatttatgtattgacagttatataaatatcctaataatttatttagatgaatgcatgcttctccattttctctgctcttttcaaagtgctggcagccacctagaatatgtctgcaccatcatccctgccctctctccatttctgtaaagaaatttgtatacagatatagaagtaaaagcaaaaaagtagtaatatatcaccacagaatgttacctcactaacacaagacattattaaatttcttcaatatctcaacaaactaaatgtgaagaacattgcaatacatacttacatatggaaaagtaaaatgcagagacaatttaaattcatgttttgcatctgtgacaatgcagctctgtgcattacaacctcatcttcaatctattgctttcttgttgaactgtactatcatttcacttaaaaactgaaagaaaataaaggttttgccttctattgtagaagcgagagttttgaaccaatctatagacagaatatttgacaaaatgagccaactctagtacacaagtgagtaataattctagttaaaattagataaagttcatgagaatttgcatactcaaattggtaaaactcacagaaaatgttagcacccttatgacttactacctgtgaaattgtgtggaacaaaataaatgtcatttttaaaaatcaacaatagcctcacaatttgcttttgtgcctctttagagaccatttgtgttgaatattgatatttcacttgttgaacattctaatgagtttgatgcataggttttgatttaaagctttttctcacaattaaagcttatgagtgtggccaatttaaatttcaaataaatttgttaagaaggtgcaatctgattcttaccttcatatgtactttaaaagtaaattctagttattattgcagaccaccttgcaatttggaagtatacagaaggaaataagatacaaatgtcaataggaataattatatcttcattgatagaatctgctattttactggtaaatcattagacatccttgcaataaaagaccatccatttctccacctcagtgtccacagaatccaaaaataaccacagaagacaaaaatcaaataaatgaacaaagaaacctcttagacttagactcactcaaaaccacattaatgctaatttaaagcaggacatctcttagatgttatccagtggtttgcctcactatttttaagacatttttctttttagctaggttttcaaatgctaagggtatattgggctgaagaaaataaggagaaaatctgctgttcagtgttgactatttgaatttcacagctgatgacataaggcttcaatcaaggtctactggataaaaagacaaaaatgttttgggctctaacattttgaaaaacaaaatctttttgcatatgttttagtttaaaacactctggaaagtcccttaaaagaacctacagtttctagaattgaaaaggacattcgaaatgaactaatccagtggttctcagactttactgcatattaaaatcacagggccgggggaggcttttcaaatatctcatgcccagtccagttaaatcagaatctctggggatggttcccagccctccacagtttcttaaagctaatccaaatatctcaatttattcaagaagaaggagaaaggaataggaaaaaccaaggaagaaaaggaaggagggaaagaggaagtttggaagttagtttgtattttcttgcctttaattgggagaaaggcaaatgaggaaggtatttatgtgactagctttctttgttaattcactgagttaagaaaaaaatcatttgcaggaagctacaatcagcaaatcataaataagggcactcactatgttagggaaaatagaatagctactatttaatattaacatacattccctacaaacatgtaatccttacaaaataagtagcgaaaattttgtaaataaccaggaaattcaaccataaactacaattcccaaggttggttggttttttttttttttttttttttttttttttgagatgaagtctcactctgtcacccaagctagagtgcagtagtatgatcttggctcactgcaacctccgcctcccaggtcaggcaattctcatgcctcagcctcctgactagctgggattacaggcatgtgcctttatgctcagctaattttttgtagtttagtagatatggggtttcactgtgttgtacagactggtcttgaattcctgagctcagacaatctgcctgcctcagcctcccaaagtgctaggattataggcatgagccaccgcgcccctggccccaagcatttttgactatattatttctacctatgaagaatatccatccaatcattagttaatatttactgaagcccatctatatgccactaagtcataattactgcacatattatagggcccatgatggacaaattcctattctcaaagactctcacaaaaagacacaaataagttgataaatagttaccactgcttgttaggtccaagaaagcatgagagagggccaccaaacccagaactgtgagtcaagaagccttctgagagcaagtgaccttccattagagaccagagtgagcaccagtgttgcacagttctgagggctcagtttagctaagggccaagaagtactgtcttgctttagaaaaggtgatgttccttgatgacctagatgaaggcacatccacaggagtggtaggcatcagtgccagcctgaagtaggttaaagaatcaaaggggtaggtgtattagaagtaatgatgcaattctttcaggagttagatgaaagcatggcagtgtgttatgcgggatataccaccgtgatttaagaaaatcgcacggggcagagttggcatcctactctgctactctctaattattctgtgtttctaaatcattgtttgcttttttgaaaaatggtaatggtaaaggttaaatgttagaatgcaggttacaagtttagtgaagttcctgccatagaaagtgctcaataaatgttagtcaaatacctatagaaatctagtgggacacattttggaaatatatttaaaacatcagaaacctgatgatgtaggtgctgatagaagcaactactagaaagaagtggttaaagaaaacagtggagaaggaataatcagaagggtgagagcatgtgtacaaatacgatgaatgagcctcggagtacatatggaaggattcagctttgactcaaggaggaagatgtaccaggaagtttgagcctggatgacacaaactgaaggagttctggccaggaatgatggctcatgcctgtaatcctagcactttgggaagctgaggcaggcagattgagaccaggggtttgagatcagccttgccaacatggtgaaaccctgttgagttagaggtatactaaaaatgcaaaaattagctgggcatggtggtgtgcatctgtagtcccagctactcgggaggctgaggcatgagaatcccttgaaccaaagaggtggaggttgcagcgagccgagactgtgcatctgcactccagcctgggcggcagagccagactatgtctccaaacaaacaaacaaataaattgaaggagttcccatttgaagttttctgtgtagtaggctgctgcgaatgtgataggaccagaagtttgagaaggatagaaggtaacatgcgcatgcagtaaatagaaggttgttgcctgggaaaacatagaaaaatgatggagggaaagtactgagggcccacacaagaacttaaaatgtcaacatgtaccccactgtgtatctggtcagagctcaacagctgaggtagtgcaggcacgcagcagatgatggatccaggcttgtggttttaccagataggtgtgatgagggtcgacagcaaaggagtgacacctgaccactttatgtttgttgaaaaatacacaatatagcttactgaactttacgcttttagataatatatttttgtaattatgcaacaattacaaacccagaaaattgttctttcagagaagattgcagctcttcagttgacagcagaggacaaactaaaatattgaatttagctgctgtatataaataatgcagcacatcatgatggcaacagttagtccatcaatctctgtcaagaacacaaactcatactgactttataaaaacaatcaagtgctacaaaaaagatgaaattcagtgccacgtccagctgtagaagtttcacagaatcttcttatttagatcttagattgtgaattcttactttttctaagcgtaaatctggtcagtcacatataaaaataacctccaaggaaaacaagtcaaacacaagttggttaacttgatcacttattaagcaaagtcacctaaaagaagaacagaacattttgctaatcactagataaaactgttatatcaatttttcaggcagaaaggtatgtaatgttaaaattacagaaaaaaaattgcaaagcctaatttcatgctttaattatatcttgtttaaaaagtcataatttaagacagcagtagaatgtcttagtttcaagttacagcatgtaaaagccaaacgggtatcttttactgttgagaatttataccttatactgcagccccaactatttactgccaggatgttttaagtcacctcattgcataacattataaactatgttgccaaacttgactgtatatgcttatctatttagtggttggcaaatacagagacatcacaaaaattaaaagtggtactctttcaactgaaaatagtcaatagacagctagttaactttggaaaagaaatcatattttaaaagtcaggtttagatcttgacgaaattttgtaaaaagtgaatgatttcatacacaccttttacaacgttttcacatgaagacaacgttttataaaagagttgatatatgttctaattccaaagaatctctaaagttctatgaagtaagtctttttattcacagccacaacagtcttagggagcaaaaacacaaatcactttgataaggcacccctctgtagacaagcttactgataaacatgagaacaaatgagctcttgaattctttaacaaacatggaatctgttattcagatttaatggctatatggccaatgcgtttccttaatgtatgggagttcttgacaaggaaagacaactgagcaattaactcagtggaagtcagaaattatgggtgttttgccactttcttggtttccaacaggtgtcaggttattgctgttaacactccaatttgcatctttatagggaacaacctaattgtaaggagaaactcaaagtgccctttcttcaggagttacagttgccttaatggaattccatttagaatacatgcttttacactaagtaaaccacataaatatttaggaagtggggttttgttacctctctgggctaccaaataaaatgtgacttgctgaaaagaagacattaagcacagaaagggacaactctttaagaacttgaatacattcaaaaacccattgcctctattctatcaatagcctcactgcattgggtcacacaacatgaccacttagtggtattcagtctctgtatccctcctgtcctcatttttgtgatgatttggtcccatcagatcctttccaaaccctgagccagccccaacatgaaagaggagggctttatgcagctctaacccaaagctcagaaaccagcactggtttatctctgctattgaagaggctttgaccttatctgtctatctcttttctcattggttgaattctctacacagttttgtcagagactctcacggggtggtatgcgtgcagtttagtatcatcttgggtacagggcttcaagttatataaaaccttggggaactcctatcccaggtcccatgtagctctgttttgacatgactgccttggcaaggaactaatggggatacctctgatgctctcagagtttgggaggataaaaaagatcttgaaccacttgtatataaatcctcttttccaccttcctctctctacattcctattacttataactagccttaggcctaaaatcacacaaactgttcctgacaaatttttctggcacaaattacctgcttgcacaaatccccaaatttcatatacccttggattcttctattccatttagtagcctatttgttagtatattttatcattttatagtaacagtagttatttttgtgccttcactatgtaccaaaaattatactaagtgttttatgggtattatcacatttaagcttcataatatccctgtgggaaaattctctgatgtgataaacctcattttacttatggaaaaaataaattttatgaattggtataatttatccaaagacacagaacagtaaatggtaaagtagtattcacatacaaacaacatggcttcagaaatgaaatctgtgtgttggaatggtttcccttgcctttagtcttcactttctcccttcacctcttcaagttcttcaccttcttcaaggtctcttcattctctaccctgtggccaattatttaatattgttgtgtattgcccacccttcttatcttttggaaagctttggcctcttgcattaatcttctcatcacttgcatatgtgatcttccttttgtgaaaataggaataattctgggtttcagtttgcagttattaacatggctatgccccttagtatgataatttatcctcctaaggtgggtaatgcttagtgtttctagaaagtaatggcagacacatgatagtagcgcagataccagaatagaccagctttcaaaaagatgctagaaagatatattggttccatactgagttttatttgagtattacaaaaggaacccatctatggcttccaatcttccttggaaaattttttgaatggccacagcatatgaatcatcatttgagttgagagtgacaagtcttggacagtagttgtttcaaagcaggttcaatatgtatctgaacaagggatttcatacatacatttgaatgtatttatgtatatgctctcttaccaaaaaaaagacaatgatgacaataaacaatcacatgaaaatgataaaatatatgaaatgacaaaatgacagtaatggagcctttggaagcctgaggttgcacatctcagtaataatttggccaaaggccaggctctgtggctcatgcctgtaatcctaacactttgggaggccgaagcaggcagactacctgagctcaggagttcgaggccagcctgggcaacatgttgaaaccccatgtctactaaaatacaaaaagttagctgggcatggctgcgtgtgcctgtagtcccagctactcgggaggctgaggcaggagaattgcttgaacccgggaggcagaggttgcagtgagccaagatcgcgccactgcactccaagctgggtgacagagtgagatctcgtctccaataaataaataaataaataaataaataacaataataatttggccaaaaagagttaactgtcctttgataatgatcctatctcatggcaggtgtacataaaatagagctgttagcagaataatgagcaacttctggactacatggcttaagagctttttttcctgttgtgaatgatactttaagcaacaaagtcaactatgcattctttctgcaaacaccagtcctttctgaatccatgttatgcttagaaaaataagattataaccatttacacgagagtaaaatggttaatcactgaaaatttaaagcatacatatttaaaatgacacagcaaggatttcagacatagatatcaatatatttctaatgatatgaactacttccttcagctaacctttatttgacattgatattagtttttaattcattaatgttgcacaagaagctgctctgtacataaagattttcccttaggtttttagataaaaataacacctctgtttcacttagcatctttgatgattcacgcacttttattgttagaaaaaataagaaaatcacctatattcacaagattttaaccatggcagtataattcaggggcatatattatcaatcaccacttcgtactgttccattataaaattcaatacatctttctaattctaaaaatagtgtaagctcactgtaaacagttcagataatgcagtaatagggaaagcacaaagcacaaattctctatcatcccatatcccatcactaatttgaattatagtccacaaatctttgtccgtttagctctattcattctaatcaattattttcattttaataaaaaataaagacatatcttcctgaaaaagtttaaaaagttattacatgaactttaaacaccctcttctttttgttccctcatcatatatgtagccactgttagctcattttatgtatcctttctgaaaatttatatatgatctcttttatgtttctttcacacgaatggacagaaatggcacattgttccatttcaagtaatttttgctttgcaatatgtctcagagattgtcagcacaaagccatttcacttttttcagcaaatatatggtattcaaaaatatgaatatgtcaaaatttatatgtagttctatactattggacatttaggaggctttaattttttccttttacaaagtatttatgaatcaatcacccttgtacaaatatctctgtgaacttttacttgtacaggaaatataaccttagacatagacatatcattcaaaatttttattctgtctagtatcctttcagaaatattatctcaataaagaatactactaatagtatatcacttttagttatggttggtggcattgcagctgggactgtctccaaattaatttatattagtgtaagcaatatgttcatatgatttctgtttctccacaatagtaattttgcaaggttggctctaacaagatgaactctgagttcttatgatctaggaataaacaataaagtcagatctactttattgcataactaatccaaaagatacagaaatctgggggctcttagagctttattctggacattatccccaaagttaatgcaactgttggcaattttcccagacctagggttaggaagctcaagaggcatatcagtagacactaaagagtttccaaactacctggcctgccatcttctctaatctccccaacgttcttcactttaagtttgggataactctttatacagcaaatgatgagaatttgtaaagatggggtcactaaacaaatgctgttggatcttgtcaagtcctttgttaaatgaaaaagcagtgtatgctctatgatctctctctaaagttggagtaagcgagagaaaaatctagaaggatatgtgcaaaaatatcaacgttagttatctctagatagtgagatcacaagggtatttaaatattcttcattgtgtttatctttattttgtaatgttttctacaattatatgcactgattttttataataagaaaaaatttaatttaaaaactcacaacctataaaaacccaattagcagcaaagtagaagcagaaatgataactactaaggttgaatggaaataaacaaaggttagtgagtatcatgatgggccatgaatgttaaatgtttccttaatgtagcgaatactaaacgtgggatcttcaggagcccagcacattctcatcagacatacattgcagatgtgaaatatttaggtttatcatagctgtttaactcataagcctaaggatatatacacatctgtcagtaaatttattgatattatttgcttaccttaccatggggtttgtcaacttataacacctctttgacaaaactaatgcataaattaattctagaacaattcttattttcattaatatgtatactgagagggtgaaatttgtatttgctttaacgaacaccaacaacatactaaccactaagaacgaatcatgtggcaagcaccgttctaagttctaagcactttataagatattatctctcatgaacttcacaatcatcataggccatgaatgctactattgtcaccattttgtaataaaaaaagttaataaaaagtaacttacaactttaatttcttattctccgacctagagcctgacagaaagagtgaagtgatatccgtggagaaggcagacatgaaaatatcatagaaacataaataacggtctagattacttatacagccaaacctgaaaaaaaatccctagtcattcatcaatcccttcattcactcaaagaacatttattgtgctcctactggattcaaagtgcagggttaattcgtatgagttataccacgaatttgtgacacagtcctggtctacccaatttattctttaaattttatctaaatattttaaaattcatcttttctgagactttctaaaagaagagaaatagacctaattgaccctatttgaaaataccacattattaataagtattgtaatatgaaattagatgtgaaattagaatgcccgtttaactatcacttaaaataaaggagagacctggctaacacggggaaaccccgtctccactaaaaatacaaaaaattagccgggcttggtggtgggcgcctgtagtcccagctactcgggagactgaggcaggagaatggtgtgaacccgggaggcagagtttgcagtgagccgagattgcgccactgcactccagcctgggcgacagagcgagactctgtctctacaaataaataaataaataaataaataaataaataaataaataaatataaaataaaggagagacttagtctattgcagaaggaaaattaatgctgatgttcacaggatcccttataaatgatttatgtgccttgggttgtccccatgaagcccccagtcactgatatgttgtaagcttgtaagctactgaaatttacttacctctggaaaagaaaatctattttatgttcacttaaaaccccttatcaagtttttcactttgattaatgaaattatgtttcatgctttttcaagtaattacttaattactaaatcagctacaatccaataccattaggaataaaattcaattttagtaactttattggtgtgataaaatctaaaagcatttccagggtcaatatagaaactcctcaggcaggatggcataaattgatagcagtcaaaggaattacagaccacatcctcaactgtggaatgattccattttggatacttagttactgcttttttctcagaagattttctcggagcttttcttcttcttagcttaattttaaaaagttttgttttgttcttttacaggaagaaaatctggaactactgacaatgtaatgattaaaaatgtggagttaaagctcaagaggaatgcaagcatatgcaataacaacgctcacacttaggttagccttcatcggctttcttgtaacttctttatttgttaatgtgaagaaggaaatataattatttatatttttgaatctaaacatagtgtttttctataagggcttaaaaatccagaaactgatgagatcaattgaaattttaaaatcttctagttactacctaggcaaattttccaaatccaaataatttctttaacttcattgtcctaatgtacaagataaaaataattatatattataattataaatacctcaccaacctccacgtaattgtcataaagataaaaatatacgctaaagtcctttttcaagtctaaggaggttttaacttatttatcaaagatttgttgatattaataagcaatttattgaatatttcctatgtaccaggaagcatatctagtaactacacatatgtatgtgtaggtatatatatgcacatatataattcatttaatacacaaaataaacatgaggttggccttaatatcagcatttcacaagtgagaaagtagtttaagaggcttagaattttgcctaataaatgcaactcataaatggtataattcaacaccaggcttaccgagctatctgatattctatgctagggtgccagttgctttgaaacccaaaagaatctgaatttagacagctggagagaagttgtaattgttatctgaacacattttttaaacagcactataaaaatcctaattatctttgcaaatataagatggaagtatgaattattttttttttcctggaagctgccacgatggatgtcttgattaatatttcctaaagaaaatggaatgtatggttaccacattgtgtcaacattgttgtgttattttagaaatgtattgacttgggagtggccagtgtctcaacctctgtttctctacagttttctcggctttgcttgtctccagtatctagttaggatcagaggcatttttcatacaaggctaaaaagacaaaagcagtaattacagattcacatccaaaccccatgatatccagaagaagtcagggagtaataagcatcctttagtaagagcaaggaaatttcttttccaaaagaattggaaatttttccctcactacatttcggccctcaatgtacaatgccagattcctgacccaattcctatctttagggcgctaatggtcccaagcctgagttcctgaatcaatcactctgccaaagagaaagggatttcctttagaacaattgttctgctctccttaggcagagcaacatgaatctgctcataatgaaccctgtcagactcctgggttcacacctagctttcccacatacttaagtcccttaatctcttcatgttttgctcccacgtgtaaaaagtgaggataataacagcgtctgcctgataaggtggtggtaggcattaaagaagttaatattcataaaaatgtttttaaaatgcctcacacataaaataagtgttacttaggtcttaaataaacccatgaaatctacttgaatagtgagaaacacagcattgccacagtggcctaaaacttctcaaccacacatcttttgttttagagtctctatgcaaatgtcccttttaatgtctattttcacttcattaatgtttctaccacactcctcaaacacacggtgaaatcagcaccatggtttgtctacttctcatggtgctggattctttcacgcctctaaatagttctacatatctatctccttgtatttctatacctttataatatgagaaggagttaggccaccctgttttgacacctgcacaactctttattataaccccagtacttgttaatattcttcccagtgtgtacatctatgccttgttgtcaatattctgtcaagattttgaccacaggtggggatgatctaacctatttttcccctatctttgtccatctgcttttactccagttgttatagttctgatttgaaaagtgctatttgaattagagcatcctaaaatattttatttatttattttttatttcttttagagacagcgtcttgctctgtcacccaggctggagttcagtggtgcaatcatggctcactgcagcctcgaacttccaggctcatgtgattctccttagcctcccaagtaggtagcactacaggtatgcccaccacgcccagataatttttaaattttttgtaaagacagggtcccactgtgttgctcaggctggtcttgaactcctggactcaagcaatcctcccaccttggcctccaaaagtgctgggatcacaggcttaatatcacaccaggccctaatatattttaatatcatttttactttcaacatttaacctctctatggtcactatttcccagtaacattctagaccaattttcacaaatattgagatgattttaagtagttgaaaaaatgctttatgtatttctttcactattcatcagaaaaaataaaaccagcatatgaaatctattttaaggatattattgctaatttcattttagtaaaatgtggaataatttttttaatgttagtttttacttaaaatggtggtaaatggacatagaaaaaattctggctatcagaacaaatgactgatttttggaaacaccaaaaacagtgataactacacacatacacacacacacagacacacacagacacacatacacatacagacacacacagacacacacacacacaaagagagaaagaccttcagagcacagtagtaatcagagaggtaataataaagaattcattgcattttatagcaatttaattcttttagtgtatgctcataaatgtatatgttactgccagtctcgcaaaataaccctttagtttagtataagatatactcataaaatttcagagacaaaaaggaccccagagactgtattcttcatgaattctttgctctttaaatgtttaaaaggaggtctagaaatgtaatgacaagtcacacagccaggtggcggcacatttttggattggaatcttaatctccagatccccaaatcagtgtttgttagtttgttggtgtttttactgtaccaaaccacctactccatagttattcttctgttaagcgtggaaaaaactgtggctctagtgctaaggcaagactagaaaccagtttcaatgagtcaagccccatactatttctcctatctgctaagccacaaatatgagagtgtcacaaaatccattttcctacaatcatatagtagaacatgattattgtcaaatgtgcaaaataattatcacaaatatcttgtaccagtttttgatgtcttacctaagccactcttatttaaaatagtttgttcttttagcagcacaagaaggaaattagaggtagctatataaaatgtattaacattcccttagcaatcaatctcaattatgtataagttatcatgtgttggtctcatttacaaactgaatttctactgactatttttctcttatttccaactgaattggttttagtgtgggatatctgtgctagatcttaaaagaactctctgggagttctttagctttattcttaaggcaagcgaaagaggtgataatctagaatacttgcagctcaaataagtgattaaagaagcatcattattcacagacagtggatatgaaaggattgcaacaagtaggcaaccatattaactgagtccctagagggaggaagtggatgattttgacaaatgcatgctccaaaacaaagacctgataggtaaaatgcaaaagtaattgttgagcatcaacatttttcttgtcacatagatctattaacactagttcagggtctcattatggaaagactgaactgctttttattcactggatttatacatttgctgcagggagattttctagtttacatttttcattgcatgactattcagtaaatattctgcttgtgttgctgggatctctcttacagtcctgagtcttgcaaagccaccctggagtcatccactgttttccttcctacacacctttctgggtctttttgggctgctctttgccatctcatcctatcttatctcattcttttgttggctgcttattcacatacatttgtatgtagaacttcagttttcttaaaattacacagaaaatccccaaatgagaaatatggtcctcttgctgcaatccagttttagaagattggtgtgagagtgtgcctaaatttatagtcagatgaattttttaaaatatttacattttttagatgattgtaaattttgaacacaaattcaagatgtgctttcagaattgtcagctctggttaactttctccatatacagtacttaatctctaactattctgtaattgcttttctgtaacttttaatcgtttccttcataatcttactcaagcatttgctttttgatctgtttatttagattaccaatgtctttattttctcttgccattgctttgattatatacttattttttttaattgagatggagtcttgctctgtcacccaagctggagtgtagtggcgtgatcttggctcactgcaacctctccctccctggtttaagcaattctcctgcctcagactctggagtagctggaattacaggtgcacaccaccacgctcggctaaatttttttttttatttttagtagagatggggtttcaccatgttggccaggctggtctcaaactcctgacctcgcgatccacccgcctaggcctcccaaagtgctgggattacaggcttgagacaacacgcctgccgatgatatacttactttttgactttatgttcatgtcaagtatttttagttatatatagcacactcaaagaataaataaactacatcaggcatcttttaaccatttaaacttttcaaacatattacgcataataatcactacattgttattctgtaatcttagccccttaacaccagtagtctataaaatgctacttattacataaagtaaaccattttaaaagttaaaaagctgatgtcaccttttgcttaaacattttaattattggctgcaatgaatggaatgtttacatccccccaagattcatatgttgaaattttaacccccaaggcgatggtattaagaggtggggcttttaggctgtgattagtgtccttataacagagaccccagaaacttccttgccctctctgctacgtgaggttataccgagaagagagccgatctctgaggaagcagaccctcacagacacaaaatctgcggacaccttgatcttggacttccagcctccagtactgtgaaaaataaatttctgttttctaataagccacccagtctatattattttgttacagcagcccaaataagatattgattatttgctattttatattatattaagaactgcatttatttgtaaaaatcttgccatttgcctacttgtgtagctacaccagttgttaagatcagtatttgaaatatactgtttactgcctaacatttataagacataattcagtatgagtgccataacttttcattgattcattcactcaacatatattttaagaacctacctttgcttcacatagtgaaataccaacttatcatagacatatattttaaatttatatcatttacacaggggctttgtaaaatatttttctcaaaaaattgagctaataaaaatcaaatcaaaattgatttttttaatgtagaaatccttttcaatacaggaaataaacccctttttttgaaagttaatacgcatgataatgtaattattggaaattatgaaggtccttttaccgtagtataccccaacatacaatccctgaagattcaaccttttaatttctccatccatgtcactggaaatctaataaaacctgtttgtgtgtaccatattttccccaaataactcaaagtggttatgtaaatatctttttttaagtcacagctcatatcaatcacgtagtctagtctgttgtctctattttataaatggaaagttagacgcaaacagacaaaaaggcaaatgtctaagcaagattttaaggatgagtaagagtttatgtatgaaccaacagtagatggaagagtagagcatttcaaacaacatatggaaaagaatgaaagcataacattacagactgtctattcctctcttgtgtttcactgtatatttcattcattcctccaaattacgtcatctgtaactaaatatagcagatgaacttgaacatacatagagagaatttttttttgtttttccagcatcaaacctggcatgaagtaagagactcaaaaattatttgggcttctacagaatcagatgagtaaatacttcctcaaactaccacattatatggtaatagctaaaaactctgatttctgatcttctcattttcattcttgcaacacaaatcagcatgttgaggacctaccacgtgcccaatattatatcaggtatagaaaaaatgtctgacatgcccccatattgaagaaaggaaataataacatatttcgtgtgggtccactgttacttcttagattctaacgtaatcttgagaagaacaaacttttctccatgtaatgaaaaagaatagtgcagattgccaatgcataacacatttaccctgctgaattgcccttgcttaggtaaatgtggatgtgctgactcctctcccagaggaccaagtattccccatcctgactcctcctgttctctttgatatttctgacatggagtggctaaagattgtccctactcatgtttcctgctgttcttgagatcacacaaaggagagtgtggtataatttaagggatacaggctttaggagccatatcaatattttttcaccaccccctcccctagatttactacttttagccttgttaccttggtaaaatccttctatgcctcaatttcctttccattcttaaattagtagacttaaataggataccatgataatgcctgtaaagtaactggtacaattcctagtgtacaataggtatcaatggctgtaaatttcctacctcccttatcctttttcatgaaagaaaatttattcgaaggctgccatattataaaggtcattaagtccaactccctccaggaagcaggaataattcaaatatatgtgggtaatcacatcaaagtagtgtcttaactattagtaagcccaatcaataaaaataaatcctgtactctcctagagaagttttctcaacatcccagtgacatgctaaaaactgtttacttatatttacttatgggagtcctgccatctagattagcataaatactgtaatctgcattctacatatacatttttggtttgtacacaatagtacttaccaagattgtaatcactgtatttgctaaacccaaaatagctgaagctttatgaacagattatgctatgatgtacatatcttaaaactattccattttaatttgtagacaaagctattatttactttgaataataatactttgctgtttgttaccttgcctctcaggttctaatttggatggatgccttggtctaaaaaagagctttgccctttgctatcactcttccttgtcctctccttactaccgtgacccacttctcagagtgaaatcatagggcagaagcttcgataagatatttcttccgccctctctgctgacactttccctttcccagcttccattccaaaattgtttgatcattttactgctgcacattctctccagacacccaggaattctgtactaaaataagcattcctttattgccaatggactgatacacccagtacttaatccctggggtctctttgccgctatttaatgtaccactgctcatgaattgatgctgtccagttttcacagaagactgaaaactgaacatttcctttgctttatggtgcttgacactttggccacatttgcttttcactcttctcacatgacttgtatcaccaaagggcaatggctgagtaagagaggcaaaatgtaatgtttctacatctttgctttctataaaatgcctagcaaagaattgtttccttgtgatgccccaggaatcatatccctcattgcccttcccttctctttaactttactgagtagaaatgagtgtcatttagaataggggtgcccatcccccaggccatgactggtactgccttcagtttcatctccttgaaattgatataatttaatcagatcatgatctctagaagcattcattcaatggtgactattttactagtatattctaatgatccagcatgtctacagtgttttctgtacaattactctacctgtatgtatgtttttcttatcagacagtattcttatggctattaagtatgatgttgcctttacttctttcttgtgagccactatctgtgaatatattttttaaaatcacgttttcatcccacgactgtcggcactgcactgtggttaagaatgtgagccctggaattctgtctttgtcatagactagttttgtaagtttggaaaaatcactgaagatctataatttggtgatcacttctgtaaaggagaaaaacctaggccaggggtggtggttcacgcttgaaatctcaacactttggaaagctgacacagtaggatggcttgagcccaggagttctgggcaacatggtgagactctatctctacaaaaaatttaaaaaaatagctaggcgtggtggtgcatgcccatagtcccatctacacaggaggatgagggcttaggtaggaggattgcttgagcccatgagtttgaagctacagtgaatgaagatcaccccctgcactccagcctgggcaacaaagcaagactctgtcaaaaaaaaaaaaaaaaaaaaaaaggaaataaaaaccttggcatctaattcacaggatcattgtgaaaattaaataagttaatgtttgcaaagccctgagaacagtggttggcacatattaaatgttcaataaatgaccattattattatcaactacaagtattccatgacctatttaaggaatcttataagttttctgaagtctaatgcattctctttttcttaccagtttgttctcattcaattctatttcttacctttactgtgatcaacagaattcaaaacatgactttcataatttctgatattttattcataggctactgtctaaatcagtttaaagtagaataataatttgactacaaatggagaaatgtgggttctatcatgtctgacatcacttcaagcccaaacacattattcatttaccttttgaatgccttttgcaacccacattccctttcagtaatgggcactccactatagtgcattttagatcttgtttaaatctgactcatgtttccatcttatcctaatgccataatccacatgaaacactcagcaaagtatctaatcagtgcttaaaaatgttagctgttaatatggtttgtgggtgacatctgtgatcacagtgtggaaatggcaagtacacattttttctttttctgcatgggcagttgtgtgtatactcttgactccagcttgttctcttctgattatgacaaccagatgctctctaatctaatcctggctctgctaataataaactataaccccaggcagtccaaatacttattttaaattatgagatatttgaagagtgaaaagaagtatgaagaatagtataatgaacacctatgtatctaccacctaactgccagatttcagcatattcaacttttatttcactttttttttttttttttttttttttgaggtggagtctcactctgtcacctggactggaataaatgcagtggtgcgatctcggctcgctgcaacctctgcctcccggattcaagtgattctgctgcctcagcctctgaagtagctgggattacaggtgccggccactacacccagctaattttttttttttcatttttagtagagatggggtttcaccatgttggccaggctggtctcgaactcctgagctcgtgatttgtccacctcagcctcccaaagtgctgggattacaggcgtgagccaccgtgcccggcctcatattttttaaagaaacaaaacattaaagatacagttgtaagtctctgtgtgcccctcttttattacattcttttctcttgcaccctcttcagaagccactaatacaatttttatatttataatatgaatgcatgatttgtacttttaaaacaatctagaggtctactttactctctaaattttacatatgttatcaactttccttctatatgttgctttgtttcctgaaacagtgtttttgaaatttatccgttttacccagaaaacttcaattcatacactttagttgctttatagcattttattgtataaatctaccataatttatttcttcattctcctgtttacagatatttgggattgaagtttttcctgttttttgcaattacattttaatatatttttccttgtaccctgtgcaaaaatttattttggatatgtacctacagataaagtagctgcatgaaatgatgtgtatttactaaactattctcaaattgtttttcaagcagtggtatctacttatattcccaccaccagtgggttaaagtctctactgcttatatcccagctttttattatctgtgaatcaatgagtatagtatcatatcaatgcattgttttagcttgcatttctctgatttctgttcagctttcttttttttactttgaggaaggtgaaatatgtagttaagtatataatattaatattcagtaactgttatttctttttcagtctgtttcacacactttttgaaaaactagtacagagagatcacattttatcattcgatttgttcttgaaattacctgatcaaatgttacgtaggaaatataaaagggtataaataaaatgcatctatttctttttttttttaaccaacgttactgtgaaagaaggtaagctggtaaagtttatattgggctgatgtgttcagtattcatatataggagcagatatagagcataagaaacatataaaagagctgactataaatgtccactaagcaaggctacggtttattcccaattgtgccatcccatattggtatttaatagatggctgttgatgatacaataatcataacatcatggtgataatcattataataattataagatcagttaactattcatgtttagttaggttcagaaactgctgtgattatggttgactgctgtctttttaaaagcacaattttcttcaccctaacttcaattttttccataagaacaaaactaggataactctggatttgctgaggtatctttaaagtcttctatttttgaagcaaagtgtgactctaggttttccttcagaggccattttaaatgaaaccagtctacagcttaaaaaccttcagtggtgcaacactgagtttgcaacaatcatctcaattatttagaacagcacacaaatccctgtccacatttctaaccatattgaacacgactacttataattcacaaatcttcctcaatctctcattatcactgggcaccacagtgcattatcccttctggaaaaaagtaatgttttacatatattccttgtgtcctagcatatattcctagttttctttctactcctctgtaagcttttttgtttgttttgtttgcccaccaggtatcttaagtcatatgtctctatgagatcacaagtttactatgttcaaaattgaacataagctccctcaaaccaccccgcaaaacttttcagtgaaaagcacaccactcatccagctgtacaggaccaggtagaggagccccttcctctcattcccagagttcaatctatcaccaaatccttttcatattctacctcctaaaacatcctggtacctattcacttccttccacctccattctcaacaccatcatcgcacctcacatctttacttcagatgctccctttgccaagaatccccaccctcattattattcattttctccccaggtctgtttaatatacatgtctgtgatttgtcacattcattagccatttgggttgtttaatttgtctatttttaaaacaaaatgcattgtcaatatttgtaaatattctgtatgtatatgtttattctacttttagctccttttagtctttatctcttcattgtgaagtgacctttccaagtcccagttgtcttctttggcactcatgagtggtgcagcaatgcctcccagaagccccatgacatttctcctacggcatggctactatacccatgcacttgtcctatttactggtcccctgtgcctccagaccatgaaattgttaaggacaaaggcccattcttcctgactttatcaccagcacctagcatgctacacaggccatcatcactgtccaaaaaatctcggctgcaataattggttataatcaatctcatgatattgatatttccaaggaaactagtggtagggttacatgattacttttctgtttttgttgcttttgactaagtaatgtttctgcttgaaataatgataatgttaatttccaaaaatctgtaaatccttttgtcctaacctcataattaaaagtgatgcagtaaaaacaaaagatctgaggaattcaaagaccaaagatcatacttggaaatagaccctgcagcaaactgctggaaagctatctttgttttcagtataaaaaagaaaattctatcccattacttcttaaaatgcattttttttatttgtagttaagtaacattcagcatacagaaaacaatggggaaaatctataaaaactatcattttcagtgacattctgtgaccagagaatgctctgtgatgggttgaagtttagtttaacaaacaaaacaaacatctgtcacaagaagtcagtacctacaagagtgtttctaaaggcatgtgtaagttattctgtgttaaatagcactatgattatatttgaaccatatacgtaaatatgcataacagtaaatttgaatgttcttgaataagtgggccccttttaagtgtcaaaaaaatcatgaacacttacataacctgaattgcactattaatattcattgattctaaggaaaagcttactgataaaatgctatcattaattaagtaaagtacatttaaattttctaattccaacagaaataggtgtgtatgcaaatccatattacatatgtttgtgtgaatgatatttatctagccttcaaatgctactttgcctacatattgatttgctaatctgaagccagttgggagctacagtatctcatatttaagaagcattactagttagaaagcaggaaccatgtcttagagggttttgcattctcatgcgtagcacggtgtctggcacgtataatagcaatagatatgcaataaatgcccagatgagtaaaccaaaacactttgtctgtaggatattataaaattaatgttgttcatacttaagtgagacaaaatatattcatgaaagaaaaccataataaaaagattatcttatgtcagacttgggcttctaggttcctgaaaataaattcacatgtagttactaatatgtttggtcacacttggcatgcattgctgcactttcagtgatagtggctgctttagccatggatttgatgaagggaagggatgggctgtggaacgcctcagatagaaagttcttacagagaaagtgtcatggtgactattctgtcagtggcaggagggatccagtggcactgattaatatcagtgccagtgctttatatggaaatggggaaacacgcagagcacagaactgaaattatattatacgtgtagttccttttgcctgtttgaacattattgctggcggccagaatctcaacctatataattccatgggaatttttttcatggattcacccaagatgaaactcttgtcctgtatctttaaatttttgctttagctctaggcttacagtgaactctgtagtcaggctgcataaatattcctgagctttggctttctgcaccaaactctcctgagaatagcataggcagtagattgcagttaaggattttttaaatgttttaattttgtgatagcatgcattttcacaaaaaccaatgtgtgctttagcttgctacactctccccattctatatatttagagggaagagagtagggagtcatagagcctgtcgttattttaaaagaaaaagccatagatgtccacgtgaaagagcagaagatttattaatggaaaatgaaataaataaaatactctctaaagtataaaaagactattcagcaataaatcttgcagtacaggctgatatgcagtgcttaaggtcttatcaagcctatactgaaggaattcagtagacagttacactatgaatcaagacaatatatttagcatatactctgcgtttgcttgcttttttattttgttaaactttcgccaggctttgaccacattacatatttagttggagtctttatataagggagccatgattttactttttgtatactttataacttattaggtaaaatggggcaatagaataaatagaataatgcagggtttatttgttctttctgaaggttttggatacaattatttctcatggtttttcttttgccctcataaaataaggctctgcacctcaggttggaatcaattaggctgatcctcagctgttcagcattcaaggttcccagtggggcagcctgtatgtacctgctctccccactgaggttttaagctgaacttctggaattgtgcccagtctttgggccagacacagtatctcagcaatgctagtgcagaagtctagtaggtaaaaacctctttcatggtttagataaaaatctattggtgctcttctaaaaacaatcctctacctgaaatgcttgtaaccagaaaataacactggcaattagagaggaagacagccacataatgggagatgcagagactctgggttggtgattatttatataatattgttgaatggtataatagatgcatacgttctattgagctaaagctgtatttatccacttgccttattttcataaagaatatatagtaatctaatttctaaagaaaaatgtgctatgtggattctttatacaagaatgagagcttatttttggatgtaataagaaatgtgaaattattattattaagaaagtaagatgtgggtatttctcttccaaaggtgttggtcttctctgcagcatatctccagatcatcgtcagcaggactgagttgaacaaattgaagaaaacaacagtattgcttttcagattctgaataatttgcaatattaaatttgtagatcaaatcagcatttaaatatctgtcaaaatgattgctaatacaatttggaattcaggttgaattttgaaattaatgaaactacacaagcttaatgaacattagggattaaaatgcaagaatttctgtactatggaaggacacatgcacaggcctgctttttacaagatcacagggggaaatgaagggaattcttgaaatcaaaaacgctgctaaatacaaatgtcaaatcttagtcatcttcttacttgaccaatgagcagcattagacagagttgaatgctgtctactctgtgaaacattttctttacttggtttccaatacacattttctttgatttccctcctccttctctagccattccttcttagcgggctcttcctcttcctctctaactcttaattttagagtgctccagggctcagtccctggacctcttgtcttttctatctatactcattccctttgtaacttcaaatagtcttcttggctttaaataccatccacagactgaagactctaacatttttgctatatcccctaaaaaccccagatttatactcacgaactcacttggatgactaatctgcatctcaaatttaacatgtccacactcctgataatttccccagacctacttttcccgttgtctttctcatctcagttaacgtcaacttcattcttccagtggcttgggccaaaacccttagaggcattcatgactcatcactttctctcatacccacatcctctctgtgggcagtttatgttgcctttacctttaaaatacatccagaatgtgaccatttctcacccctacacttctaacacccgagttcaatccataatcctcttttgcctgggtgactgcaataacctcatttctttgcttttatttttgatgttttcactatcttctcaacatgcagcaagagtgattttgttaaaaaatgtcaggttatgcttcccctttggttaaaattctcattgtgatgatgaaattctaaaatttagcagggagtataatgcaggccctgaccaactgaaattcatgctaacatccacctactaagattggaccaatacctaccaagtaaatatcaactgtactcagagggcttcacatcgtcctgtcacctcgggatatttccatctaaacactttcctctgtttggaatgcttttgctccaagcaagagtctcatcttccttaagtctttactaagaaattatcttctcagaaagctttcccctgactactcaacttaaaattgcaggtcttcctgaccccaaatcctggccttccttaggaacactgatcaccaaatgtcatactacacattttacataaatatcttgtttattgtctctcttccccactataatgaatccccacaagaatagactttttttttttactcctatacccatcacttagaacaaggtctacataaaataagtgctcgagaatacttgttgaattaaagttgaataaataaatgaacaaatgaaagcaacgtatagtgtggagctaagaaacgcagctcaaagcttggggattgtaactgtacctgtcttatcctagaatggcacatttaaaaaatgtttttgtttttgttatttctaggtgaactgctaaattcaatagtttccatctagatttctaaatggagctgggaatatataaacaaacaaacaaataaataagtagagtaagtctacaatgtgagtttggctttttagtgttaataatgttacacatttaacattccgtgacattatctaaataaacttacttaaactcacccaataacaataagagtgtttgtttaacttttccttcccttaaattagcaaaacagcttaatcagggtaacaaagagctgcttgagttttatatactgtgccttcttcccagaacttactatttcccagctcctccatgaggagagattttacctctgagttcttattatttccattttctcttaacgagctctttctgctcagcattgataaatgctcaaatcatcacaaacacttcctcccttatgactccttcagtcacttcactgcttgcaagttgtagtctgtccccaattcctcacctaaaaaggaacacccagagccccttggttgtgaatctagtgggtattccttggtctttatcctacctgactttccgtcaacaactgagatgactaacatctgattcttaggacactttccttattgatagcattcattcatttatctccttccattcctttgactaacctctctgggtattctttctcacattatttgtttatcagaaatgaatacgcttactgaagttttttctaataaggtcagatacttccaacttttaagttaagaaattgtttaagcactaaaatatgttaatgaaatgaaaacattaataaattagttctatacttccacagacatattctgactataaatcttaagtaatttcattttaatatcccactgcctaatgaaaagaattaagcacatacacttcctaacttctaagtaacagattgtggaggatgctttaatgggaccctcagatcctccttcaggaacaaaacattaatttccccagccacaagtgttggatcctgaaagctcacaagttagtacctccctactcattctcctgcccaataaaactacctcatctgcatgtcttccctgaggacagccatatccaaggactgcttgatgctggggtgaaaaagcacaacccccttgtctcaatgccagacaatgtggaagagccatgctagcttcagagctccccatgacactatctgagagctcttttacaaccaccactcagtaagcctccccgtcttcccagtgctgctgcccttactccctctaagagctcttcttgcacatcaatctccatttcagactctggtgcctgggaaattccatctagacatacgtcatctctaatacttgagatactgagtgtctgtgctaccgaacgttggcagaatatgccacctcaaaattagccactttggcataaggcatttcaaaaatagcaggaaaaaaagagtctgaccttctttctcctccctgtaccaggaagaaagaaatatttttcttaccagagatggtgagtcaaggctgaaaagtatctgtaccaacagatcttataaaaataatttttatcttccttagctatcccatacatattagttacttatccactatcaccagactttgttcaacctaatgtataaacatctgggttttgccacttctttcggtcttcattttcttgtggagatttctaggtgcatgtaaaataaactctacgattttctcctattaatctgccttatgtcaatctagtctcaaacctagccaaagatcctaagagtgcagaggtagagctttgccttccctacttcatttcaagtggctcagtttcaacccttgaacagaatgccactgaacatttgtgatttcagctttagtctcactgcaacatttaaactaaaaatattctctactaagccagagaagttggtcacattataatctccttgataacctgctttaaaatttcaatatgtagtactagaaaaaaatgcaaggtagtgcctgcccaacagtgagtttagttgacagaatcaagcaagttactcgtagctgcttgtcaaattgaaccaaactaaagtgagaaaagagctgataggtttagagtcaggtaaatcaattaaggcttaccatttctccttactaaattgattttcatgatcggcacgagaatgtcagccaaatgatattaggacatttaattttattttagctatatttacacacacatgaatgcacaaccggtttgcctgaatataaagaacacttgaatcagggaacaatcgcactttttaagacagaggttatcagattgaattttttgaaaatataggtatatatccttttaaaaaggtacactaaaaacaaaacaaccctgaaaggtgggaaataatatgacggtgtgtgtgccaaaacatttaacttaaagaaaagcaatgtaaataacaaaccgaatagaattttagacaaaaattgatacaaagattataagagataggtgactaaccaccaggaagtgagaacattcattatcatgtatgtgtgtgtatatatctatctatatctatatatctatatatatatctatctatatagatatatctatatatctatctatgtagatctatctatatatctatatagatctatctatatagatatatctatatatctatatatctatatatcatatacagatatatacacacacatatatatacacacacatatatatacacacacatatatatatatatacctacaggccctggatatatagaaagtaataactttaacaaaagtatagcagacaatatacagagcatcaaattatatttttgtagctccaactccaacatataaaagcacatttgccattgatatacccagatacattaaaaaagaaaaaaaactcagtgctacatctctactgcccaatacagtagcactagccacaagtggctatataaacttaaagttaaattttatttaacttaaagttaaataaaattacaattacaaattcagtgaaagtaaatttctgtttttttgtttgttttgtttttttagccaccctgtctgtggtactttgtcactgcagctccagccaaataacacatcaggtttgatatatttttacaccatactctctttcatacctgcttactaacaataattggaaatatcaataacactgatgattttttttaaatcacaaaattatgacattcaaaatttagaggttgttttctgaataagatattaaaaggcactcagaatttcagaacccatctcatgctgaataagacatagtgtcccggagccaggaaagcattcactttttataaatgcacttttgtttagttctctcagctgtgcacagaagaaacaggacagagaattgcacagatttgtgcagcatattatccaaccaacagcaatgatacaaactctcaatggcagaagagatattatgagtgtttattgttaatgtttgaaaataaaaagtggtaatgctataattatatcctatttttttaagatttgaatatatcctaccattaaaatatttggttctcatgctatatacttttctttatttcacagactaaggaatttatcagataccagaaactcatgggtatattgaataagcccagagttattgctaatgtgagaaacacactcacccacccaaacccaaagatggacttagaagcaaaaagaacagcgaaagtgagacttttaataacagccttgcaagatcgagtgtctggtaggcaggcacatctggggcagtcacaacaggtaatttatctcctagcacgcaagtccctcccctagttcctcattggtcgagtactatggggttacaatcttcccagacgttgcctaaagtttcattatctcccttataaggttatacctccatccccttccttgcttaagtttcgacttcccaaaaatgaaactttcttcccttttatgggctgacccctccgctacattctgtttgcttattgtgaccttctaggtgcaagagccctgtggtttgttacatttgcagcctggctgccagtacttagatttatcatgccttgaaaatggaccatttaaaatgttttctcacactaacaacacaatcaaagccgttgatatatttctttaacaaacacgagcaatttacaaagttaattaatttaattttcctaaaaagcttatgaataaacactattattacccaattttaaagttgggtaacgtaagatggcagagaggttgaataacttcctgaaagacactgggggcacagcctcagtttgaatccaagctgctgcctttggagtctgtgctcttaaccactgtgctacagcttaacctgcgagtagctctgctaactcttgttttcaagcgtagacttacccatgtagaggcaaacatagggaaaaatgaatcgtgtcaagttccatccgcatgtgtcccagttaaatgtctacattaaggtaaattaaagctggcaaatctacagtatttagggatacattttcaggttgtaatgtggtaaaacaagcaagaaagtgattaatataaaaataaatacagtattttgctttgccagctgtgggaggctgggggaggggggattgtggctagaaaagagtactacacagaatgtatctggattaagactgtttttttttttttgaccaaatgatgttatatgagttttctcttgaaaacaattcaatacgatgtatgtttgttttattcacttttctgtttatatgtaatttcttgcaacaaaagtcttaatacatttatatagacatacaaatacatattttaggtttgttggaaacagaacaatattatatatcccatttgcaaatgtttatataaaatacatgaagtatggcagcatccaaaaaagtaagtcaaacttacatactgtaaaattgcagattccccttcattattgcatataccataatgaccataaattaagtcatcatcggccgggtgcggtggctcacgcctgtaatcccagcacttcaggaggccgagacgggtggatcacgaggtcaggagatcgagaccatcctggctaacatggtgaaaccccgtctctactaaaaaaatagaaaaaattagccaggcattgtggcgggcacctgtagtcccagctactcgggaggctgacgcaggagaatggcatgaacccgggaggtggagctttcagtgagctgagatcattccactgcactccagcctgggtgacagagcgagactctgtctcaaaaaaaaaaaaaaaaaaaaaaaaaattaagtcatcatccagatggaaatgctgtgaaaagtttcaactagccagatatactagacaaatattcataagaaataaaacattttgaatacttattaacaaattttagttttttggcagatgtagtcatatatatgtgcatacatatatacatatatacatacatgtttatcacactcaagaattataccaattaaagggattctttatatttaaaaaataataattataaaccaaaattgattcatattgttggaaaacattataaagagttatgtagattgcacagttaggaaataaattggccaacatttactagttaatctttattaagaacttactgagtgtcaggtgctgtggtaacacattatgtgcattacgtttgtaaatcccaacaatgaattaagcagccttatgattctcatctcacagaatctagaggtaagtaacttgcccaagttacactgctggtaagaagccctacttcatcaacaacaactacacttgaaacaatagcaaaattgaagtgtgacagtaaactgaatgcaatatacattacagtataatttattttattacttacacatttcagcaaagtgcaagttttctggagtatttatcttgttcccatagatgttgtacagggaattcaataataagaatagtagccagaaaagaaaaaggcagaaaacttaacagttataagaaaatgaaaaattttagtacttttttctattcccatgctatatatcataatatagaggaaattaaagaaaaatatttttgattacataacttttaaaaataataattctgtaggtgtgaatatgtgtgtgttaacctgtatgagtgattaatatgtcattagaagaaaggatgttacccactctaaaataatgttagatgacatttatgcactaataatatgaaccacaaaaaaagtctaaaatatttcagacaatggtacttatacttaaaaatgaatttatcaatattaccaaagcaacaggaaagtctatcatcataacagtggagtattaatacccatgataaaaattaactaaattaaattatatttagatattttttgaatattcaacaagaattaatttgtaaatgagtaacaggcaaacttactgacttttcctaaatataatgactgacttctgagagctaatcagagttcactgcttcatttcaaaaatagcagagtaataatatataatattaatttaaacatattactcttaaaaaacataactacaagattttcctaaacaacttgcaacttaataatgcatactgatattaattgcaattgtttatatacaaaaacttgggttgaattctctctctgtgttgcttaactgttatacacacaccatttgctatgttttaatggaagcattttgaatacccaaagacatgtttttaattgatgaacagtgactcaggttgtcagcaatcatataggaaggaaattataggttattacaggcatgtgacagaagttaccatatttttccttcagagtttggttctaacactttgtattttggccaaatttgtagttactttaccttttctagctttgatttctgcattggcaaaatggggataattagagttactatctctatttgttgttataaagataattgtatactacacaaaagcaacaaactttgtatctgacacatagtaggtgatttgtacacatcagttacctacttttttctaactctaagaaggcttaggttgttacagaaaagttactaaagtctttccctctttcctctccccagggaacccctctttctttcctgttctatgtagtacttggagctccaggcagagaagttcaacttgctaagtaggtgccttattactgttgtatcaacattcaattttagataggtattttaatgattttgtaagtaaaagttatattctagaataaatcagttctattctgcatttcccacaggatctaggagagtggcacatactcagcaaatattaaatacatatttggaaattaaaatgaaactaactaaatcttccatctaaaatgcacaagatatttattactcattttgagaaaatatgtttttaagctgatcaaactagtatacaagttattctttatgctacctaaatttaaaacagaagagaagttcaggttgatgttttataccaagctaaacttgtgtacaactaaaggaaactggtgcagaagctctttagtttaattagatcccatctgtcaatttttgatttgtttcaattgtttttggcaacttcatcataaaatctctgccatgcctatgtcctgaatggtattgcttagagcaaaagaagccatcattagagtgatcagacaagctacagaatgggagaaaatttttacaatctacccatctgacaaaggtctattatccagaatctacaaggaacttaagcaaatttttaagaaaaaaaaccaaacaggtcaggttcgctggctcacgcctgcaatcccagcactttgggaggctgagacgggcggatcacgaggtcaggagatcgagaccatcctggctaatatggtgaaaccccgtctccactaaatatacaaaaaattagctgggtatggaagggggtgccaatagtcccagctactcaggaggctgaggcaggagaatggtgtgaacccaggaggcaaagcttgcagtgagccgagattacaccactgcactccagcctgggcgacagagcaagactccgaaaaaaaaaaaaaaaaaaaagacaccattaaaaagtgggtagaggacataaacagacacttttctaaagaggacatatatgcgaccaacaaacatggaaaaaagcttaacatcactgatcatcagagaaatgcaaatcaaaaccacaatgatatatgatctcatgccagtcagaatgacaattataaaaaatttcaagaaacaacagatgctgatgaggtttcagagaaataggaatgcttttacactgttggtgggaattagttcaaccattgtggaaaacagtgcagcaattcttcaaagatttagaaccagaaataccatttcttggggtgaacagacccaacatcaggtcgtgggggtgacgaattccggcagagtcaaaggaatgagaaaaagtcagtttgagagagaaaagtgggtccaggggaccatcgggagtttatggaggctgaggaggctgagaagcccccgagctctgggagcccatgctatttattggtaatccaacaaagaaacaggtggtgagaatgtgggaatcaaaagggcctgttgcattaaggacatgatttacagctgtgatggtttagcagtttctctgctacttgagataatggagagcaggttcttttaactcaagatacagtcgatcctgggagagcaagaaacaaggagccagcaagtctagacacattccagagccacgagccctggattctatccaagccactacagattttatgccctgggcttagattatggtgcatcagggtagccttccaccctttaacacagagcttggtgttcccaaagccctcaaggggttttagaccccggaccccagacatgttccaagactcttttacattatgtcagacatgcaagccctgcctcagcttctcccaacactcagctttttccaacaccatttgaaccagcaatcccattactgagtacatacccaaaggagtataaatcattctattataaagatacatgcacgcgtgtattccttgcagcactattcacaatagcaaagacatggaatcaacccaaatgcccatcaatgatagactggataaagaaaatgtggtacgtacacaccatggcatactatgcagccataaaaaggaatgagatcatgtcttttgcagagccactgatgaagctggaagtcatcctcagcaaactaccacaggaacagaaaactaaacactgtatgttctcacttataagtgggggctgacaatgagaagacatggacacggggaggggaacaacacacactggggcctgtcagaggcttggcagagagcatcaggaaaaacagctaatgcatactgggcttaataccaaggtgataggttgataggtgcagtaaaccaccatggcacacgtttacctatgtaacaaacctgcaaatcctgcacatgtaccctgaaacttaataaaataaaaaagaaacttctcaccagcctcccttctcacccacttaaatgtggcaactggctagattactacagggaaactgctcttgccaaaatcatatataatctccttattgtgaaagcgatgtcacacctttgttctcctctcaaattgaacaaaattgacttctccattcttgacaacactctgttcccttgggtgccaccatccacagggttcctctcttatctgattcaatgctgattcggtcttttgtggttggggcgcatcaaggatcagccctgtggctgcttcttcatcctctactacatcctctctaggccacctcacatagcctcatttgcgagctgcttactgactgctctaacatctttaatctccagcaaagaagggagccataacccgcagctaaaactgaagacctggtgctgagaaatgaaatactgtgaaggacaacttggtacagaatattctgtaagtaggttgcagtgtaggtaagagaggactacctctggaacacaccacgaggacaggtataatccccattaaacataataggaatccaatgaccaaagttgttgagctaagagatagtggtatatacacattttttaaaaaaatgatataggctaatatcgaaagaaggagcatggaactggaagtacctaaagagcagaatgggagtgttccctcttttaggactctcagcattattttttatattttctttaagcaacatgcattattacttgaagatatatgtaaccaattaatgcaagtataaaactctgaaaatgctttctttcctgagatccccactcctcatagatccctacaaacttttatactgtcattaaagcttctccagcagttctacctccttaaattaccttttttccccctataatggaaaaatcttttctctaacttttaaatttatcccccactgtcccaacataaacataaacttatattcaattgtttcatttttgtgactgtaattattgttttgtccttttctaagtagtctcaatttgatctagttttcatatgtacaaagtttcatttttcttggagttagtaattgcctttgttttaatgtacttaatgacctttgtatgtatgtacatatgtatgtataacctctatttcagttagatcttagaatggataggaggtgaacatatctgatcagttagccacctaataagtaccaatatttttgtttgcctgtagagcaatcattatcagcccataaatgtggaacattctgagtatcataacatatttgaaacttgtgttaccacataaaatatgtatattttaaaaatctaccatgtctagtctgaatttaccaacattcccaagtattagttttctaatgctgtcatatcaaattatcatgaactgactggctaataacaaacatttattttactacagttctataggcttgacgtttggcacagtactcactggattaatatcaaagtgtcagcagggctgcattcccttctggaggctagggggaagaatgtgttttattgcctttccatcttctagaggctgcctgcatttcttagcttttggccctcttacatcagcaaccttgcatctctttgactattctcccataatcacatcccctctcctctgaattgaattcaggtgggaatggttctctgattttaaatacccaggtgcttaggttggttccacctggatactataggatggtcttcttatctcaaggccccttagccttaacgacacctgcaaagtgtcttttgacaaaggaaataactatttgcagttcccctgcattaggaaagatgggcacatctttaaaagaccattattctgcctaccacatctactatcatgttgcaatcttatctataaaaatgtttaacaacactggatatgttatattctctgaaaaattattttatttcctaagtcaaacatctataataagtaatcaactatgatgatacagaaagtgaaatgcatattctaacaaatagcacagaaattcatccttaagaaatatttgttagttaagaatgactataaataataattatataagtgcttccatttataattgcctcaaaactacactcttaggtaaactgtatcttcatacataaacaaggaaatagacaaggttatgtaacatgattagaatcacagaattcttagattgcaatatttgtataccatcattaagtggtagaagctaaactagacctagaatttaggtatgctgactccaagccaaatatacatgcacacacagacacatacacacacacacacacacacgtctcataaaatattttaaaaattgtacagaatcagctgggcgcagtggctcacgcctgtaatcccaacattttgggtggctgaggcaggtggatcacctgaggtcgagagttcaagaccagcctgaccaatatggagaaaccccatctctattaaaaatacaaaattagctgatgtggtggctcatgcctgtaatcccggctactcgggaggctgaggcgggagaatcgcttgaaccctggaggcggaggttgcggtgagcccatatcatgccattgcactccagcctgggcaacaagagcgaaattctgtctcaaaaaaaaaagaaaaaaaaaaaagaaagaaatgtatagaatcatatggaatcagaagttaaaaaaaaagtcaaatgcaaactcctgaagcaaaatgaattcaactgcatgtactataaaagatagttattatgacaggacaaattttagacttgtcaatctcaaaataatcctgttaaatcaagtcctatgtaatggagcatattcttattcttttaagccttagtatttgcttgctatcatgggcgaaatacagaaatggaatggtcagctccttcttgctaaagtatgtcagcctccatcttattatataatcacaattatctttattttgtcaaaagcctgtcatacttttagtaaagaatgaaactatggctgcacagtatcatgctgcaggccactgtgactcatgactttggaaagcaatcattaatcaaataaatttaaaaaacaagattcaagcacttctgtttgtgatgagttttgcttctccttttaaggaatatctcagtaattccttagaactgactggtccaaagtaaatagaaaagaggaagatgaaaaagaaacaggaattctaagtatttcttcacctaggttcagatgtttatatttttgcgtgattttttttcctgactagaacttccagagttttcatcatattatcaaagtcctgtgggacacaggaacttaaaatctatcttgtgctgactttaaattgttgcagaggccaacattaaaataatgttaaaaaccgataaaaatatttttctttataaagagtattgactatacacgtatatagaaagtatatcttatacaaatctgtctcaaaaatcagtcatttaatgcaattataaaccttactggtaatgccttgagaaaattagtattatcatggagctttcaatttattcttttatcagctccatgttaatgttttattgcttttttttctgcagcttacattagcacattcataactagatatgcttttttaaattcacgatctcaattattttattttattgttattattattattttgagacagagtctcactctgtcgcccaggctagagtgcagtggcacaatctcggctcactgcaagctctgcctcccgggttcacgccattctcctgcctcagtctctcgagtagctgggactacaggcgcctgacaccacacccagctaattttttgtatttttagtaaagacggggtttcactgtgttagcgaggatggtctcgatctcctgacctcgtgatccgcctgcctcggcctcgcaaagtgctgagattacaggcgtaagccactgcgtccagccccaattattttattttaaatggaacccttatagccttacaaggtttggcatgggtttatcctcttcatttcccaaaaatgtccatgaaatgttatttcccaaagtacttcctgtattatctatctctattaaatgttttctttccagatagtatcatcgacttacttgctggtgatttggggcccatggaaacaatagtaaaaactaaagtattcaatcaaagtagaatgtggaaaatcctcaaaatttatagagaagactgagatcatctagcagaaatagtaaaaatatttcattcattgcttcctatgtgatttgcattgtcttcatgatgcttacaatttagttcagaagttcctaattgaatcaaaatcagagagagataggtagcttctgttctaaagagaatcattccacctaacttgggatctcattccttgttgtatctagaacatatctttgagccattggttctatcctttgtgtaatctcagagagtggatctgtacacttgtcctttgtccaagttgtcattttccattttgtttcagttatctactctctgctttctttcttagctgtttggccagaatgccctccactccgacttctctttactatgtgtgatagctaagaaatagctgtagtatatttggagtattctttctgtcacttatgttctggcttcacagtcatgacatcccacttgagggtaaaacactagcagaactagagaaccgagagctaccaccacacctgcaaagctgactgcactactcatcctccccttgctttcctaacctgcattctagccatgcataaacatgataacaacttttgaagtatagtactgtagacttttttgtcttttccattttccaaattgttaatctgccaacaagttgaattacattcatggattagtcatttacatggattagtcattctgatttcacgcgtactagtctgcactccccaatgaatttagagattaaaggcaatgtgggcatatagaaaacagtcattatattattatattttacatttgtgttgaataatttttaatttcaaaagttaatagttaaaaattatagtgaattttctaacagtacagaacagtatatacaacattttgaattctcttttattcttccagctctttaattccacttcccggaggcatcaacttgaacagcatgtctctctctctctctgtgtgtgtgtgtgtgtgtgtgtgtgtgtgtgtgtgtgtgtttgtgtgtgtgtgtgtgtgcatgcatgcccacacatgtgtctatgaataagtatttgggttaaagtggatcatgctatatataccgttttacagctaacttttccattctacaatatattgcgagaatctttccatatcaatccatataaatttataatattatttttaatgattacagagtaatatactcattggtgtgcacaagccacaatttatttaaacagtttgtgactttaaatggtttttgagaaagctacttactataatggtaaatatatgaagatacagaagtagatggtatagtaaataatatagctcatcctatatcctgtcttcaccattgagtaacaggggtgtttcctaggtgaaagctgaactggtaacaaaatctctggttttaacataatgtaacatgtctgattaaattttttggtatatgtgaatagactgacaggaatgtcaagcttagggttttcaactcaaagtcacctagggtgcaccaaaattgtgtgagctggagtatggagctttctcaatgtgttacagaacatctagggcatttctgtcatttagctgacatgcacgacggaccacaaaatggtgaatgtcagcttgcattttgtagttttgaacaggcagcctctattccacttctcttgctttaatgaagttgacacaagaattctagagaaaaaagttctagttctatgcatcctgaatgagtgtttgaaggtcaattttagaacttattgttacaaagatcaattaagtatatgaggtgaaattatgttttgaatgtcatataaaggatctgatgaatgatacatattgtcttgggataagcctaatcaaaatccattaattggttttacatatttatgactaaacctttgaaaaagttacttaaaggtgaacaaatctaagcagacaaatacaacaattggatgcaagccaggaaatcttgagcaagaggaaaactttcactttttaaaatataaaactaaagccctcactttatatgtgatggcaatgctttggaaatatataaaaagcaaggatctccctcaataaaaataagtaagtagaatcttcatcaatataatcccagagacaggaagatagttattttaatgtgatttatttagctaaaagtaaatgtgaggctcttgagagggcaaaccactgcattagagagtgatttggaacattttttgcaaactaacagaataaaatcaacttcggtataagaaggtaaataaaatctagcagccaaagataaaaataaatctagaattaacaaatccagggcttaagcagtaattaaataacccagatttcacccttttgtgatagaacaggtacatttaaatgctattaacactttttttaattccattgatttctccatggatacatatgtgaacaaatatattaaccatctctttcctctcaaatggtaaaactgtttctttggaccactgtgcaactagtttctggacctaccatgtgtaacatttgttccacaaaatttagttcttaccaggttttttgtaatcactcccaaaggctcatgttagttctattgtcattgatcccaggagcctttttagatataggctgtaatccactagctaaacgaagcaagttttctctaaagctctcagcagagtttgatttggtgctatgttgcacaattccaagctgtgagttctcctgcttatcagttaaaaattaactttaagatacaggccgagtgcggtggctcacgcctgtaatcccggcattttgggaggccaagacgcgcggctcacaagatcaggagacggaaaccatcctggccaacatggtgaaaccccgtctctattaaaaatacaaaaaattagccaggcgtggtggcacgtgcctgtaatcccagctactcgggaggctgaggcaggagaattgcttgaacccaggaggcagaggttgcagtgatccaaaatcatgccattgcactccagcctgagcgacagagcaagacttggtcttaaaagtaaataaataaataaataaataaataaataaataaatagatagataaataaataaaatacactgtgtgcatattgtccttactttcatgtcatgtccccccagattctctgatctacaaatgaacaaattcctgttcagtcttaaggagaaaaaaaaaagtctctcctttagggatgagggttctattctgcctaggtttctaactttttatgtaaaagcatcaacgcatactcaggaaattaacctaggaatagtcatgaatgaggccttctagctatatttttttcactgttggtggagaagtattagaatcaactgtcaggtaagaaggtcattggcttaagctaagcactaagcactggcttgaaacagaggagaccaatcacagctgcaaccagcctgaaaatgcatttggtgtgtattcctttaaagtcataacatttggttaattttagaaaaaggaacaaattgaggtttaatgttcataatatatttttaaaagtaggacacactttattaataataccatactggtaaatattattgttataaataatgatgattttttcccaccttctgtgaactaaatagaattttccctgggatctgggattatggcaagtggatgaattctattctacaggcgaattaactaccactgtttcttgaccaatactgttcagatggtatcagtaagttttagagcttaccaggtttgtactaaatcatgagtcaagtttcaaacacaaatcaatttctagtgaaagcaattctgtcccagtgcctctgttttattattttgtgatatgaagattgatagccaaaacttttagagttgtaaagcatgccccctgaataagtcatttcctaagatgatttaatcagcagctgtatcttacggaaagtcacactttccaaactgagctggtgattatgcttgtgcactggctttaaaccccaccttcactactcaccagctatgtgaccttaaacaagcattttgcctcactgggccttatataaagtgattcatgtaaaatgcttcacacaatacttgatacacagtgagtactcaataaaacttaactattattcatttattattccagtataatcaactaactaccaagtgtccatttcttgtgtacaagatgctagagacagaaaagacataaatgatactatcacaaaagatatatgatctagttaggaaggtacaattgaagaatgaacagaaacgcaagtgcacatctgaaaataaaagataagtcattccaaagtgagtgataggagagaagtagggttagtcaaagaagatttcatggaataagtgaatccaatccgcatcttaagttaaatgaagactgcaggctaatgaaaattggggaagatgttctaggcaaagacaaataaaaaagtcacagtgaagaaaattaacaacatgggatgaggaagtgtggtgctgaggtaatgtaaataagagaaaataaagatgctccacaaaaatagaagaaaataaagaggcccaacagaaacagagaggtcatttgcaggaatgttatataagctgcagtaattaggaaaaagaaactagacaactgctacaaaaataaacaataaaaatcagtatagtttctgggaagagaaaaataacttgtcaaaaattacatttgaaacattgcgccagcaactgtaggctgcatacattgggtcaaggaaataccagaagcacagaggtggcaggtgaagttcttcaagcaaacgaactctctctgagggagttattaaaggaaataaaagcagagagcaaggccaaacttgatgaaagtccacaattagctgcagcctgtacaagagagatataaaaaatacaggaggagaaatgagaagaaggggcataataaagtacagaagaaagtctggtctctaatgcacagagcaatgaaaaaattgagaagaatatgaattagaaggagggggaggcaaatttgggtttgaaaatagttactagggtaaaaactgaaatcagaagggtagcttgatgccagatcatgtagaactagatcaatgtaggattcctgcattgtccttttactcagtaaaaaatctgaagcaatcatgattgggtctatattttagagatataattctgcccaacagtataaagaaaataatgaggacaaagcaagttgaaggcagggagatatttaagggatcacctacaaaactcagtgtgagagaagtggacataggaaagaagagaagaggaatttaagaaaaatctgagatgtagaatcgatatgatctagtggctaacaggtcctcttaattgctggtctttattacaaataaattatccagtttgggcataaagaggaaagattacaaagcatttgttttgaaaacgctgagtgtgaatggcctggaggatatgcaaataggcagatactaactggtatctggaatctggaagagagaagcagtgattgtttgtaggaaagactgtaaaccttaaggtgacatgcacatataaatattcctaatgtgtctagttacccaaagaaagtattttcctagtctgctgtacagcagtttaaaatagtgatcatcttaattgtaattggcttttatatgatgggtacatgctatctattgtatttcaagttaattcaatttcatttggaagaattgttatttccttggccatgtacaaaattaaatttagtactctttctcaggaagtaatttttagaaatattaaaataaaacagacagtaaattattaatctgtgattcaattttataaaacaaaaatctatctgaacaagatgagtcataatgttatgtgtaaaactaaaaacatttttaaataatatcatttgtataaaaagatcaattggtctgatacatatttgattgtaatttttaaaatttaaatatgtttctttttacagcagtatatttttcaaacagattccttaggagatttaatgcaaccttatgatcacggaagtggcgaaaattccatcaccaatcactcagttacttcatttgggacccatgacaaatagttgattagatttttacaggatatattaaaggatactgtcgaatttcttttcaaagtttatataaagatacagaactcaatacagtataatgtacttacatttcctctcatgagctgtgagtctggtgctacatattgaggacacgatttttaactttaaagctcaaactcctatggcataattatgttgaagattagtatctcatgacagaatttccccatttatcctctcttctccacagaaataaaacttttctttttgtaattaattgttgggggttttgtttgtttctcaagccaacaatgctatctttctttggtagtgataaatgtttttcctctttctttttttttctttgtttttttttttttttggcgatttcttttctttttttttattattatactttaagttttagggtacatgtgcacaatatgccagttagttacatatgtatacatgtgacatgctggtgcactgtacccactaactcttcatctagcattaggtatatctcccagtgctatcccttcccccgtccccccaccccacaacagtccccagagtgtgatgttctccttcctgtgtccatgtgttctcattgttcaattcccacctatgagcgagaatatacggtgtttggttttttgtccttgcgatagtttactgagaatgatgatttccactttcatccatgtccctacaaaggacatgaactcatcattttttatggctgcatagtattccatggtgtatatgtgccacattttcttaatccagtcgatcattgttggacatttgggttgattccaagtctttgctattgtgaatagtgccgcaataaacacgtgtgcatgtgtctttatagcagcatgatttatagtcctttgggtatatacccagtaatgggatggctgggtcaaatggtatttctagttctagatccctgaagaattgccacactgacttccacaatggttgaactagtttacagtcccaccaacagtgtgaaagtgttcctatttctccacatcagtttcactccatgttatcactgcttcccctcaattccagagatgccttacaaataccaaatagaaaacctcagttaagagagaagaattttcatgaaaaattaataacaattctgacaaagctaccacacatcttaaaatgatactctaaagtcattctcttgacaaaataactgaaccttgaaatctacacattcttttagaaaatacttttcagctcaaagtaacatttaataaatagttactgttacataaaatgctaatgatgacaatgaggtcagattagaaatcttcagattaatgaaggtaatttatccaaagtgtgagagaaaataaaaatatttttacacgtggggggaggttaccttagggcaatgttaagtttcgagccctgctgtcattatgttaaaaccatgtattctaagaacagtatgttccttttcctttttgttaagactgcaatttttaagtcatttaaataattcacagaaaaaaatagtaatcttaaaaattaattctagtatgccctagatgacaggcaagtgttgaaaaaataaatttctcatctaagcactatgagtgacatgaccatctggagcgctaattctaaatcttctgagatcacaattaatttttctttatccttatacaaatatttgctgtgtcctaaggtcttgctcacccagagcctctgtccttgtaggtcattttttaaaatagatatacacacccaaacctcactttggttgagttataacttacatacagtaaagtacacaagtcacgcgtatggagctccatgtgtacatatctatgtacccctagagcctcctagattaaaacataagtcatttctcacactccacaaagctctcctgtgcgcttacccagtcaaaaatcaacccttgaaggtaaccactttcctagctagcatcatcacaggtcacttttgcctgctcctggatttcacatgaattgaatgtattctatcatgtctgttttttttttccacccaacattatgtccatgagattcatcaatatcattggatgaagtagttttccttcatttctgtattttcttgatgaatatgccaatttatttactcttcttgtggctgatggtcatttggttatttccggttttttaatataaataatgccactatagacattttttataagcaacttatttttaattgcttagttttaggttacatgtatgttagttagtgtgttaacttatattagcttcagaagatggtaacacacagcttcccaactggtagtaccaatgtaccctcccactattcaatgtattttctttttttttttctttttttttttttttacatgcagtatgatttattttatataatgttcaaaagcttgcaaaaacagcatattgtttacagatgcatattttggaggtaaaattatgaagaaaagcgagatcattataaacaaaatttaggagggggctgggatggagaagggcatgcaaaagggctttaacgtgttggttgtaatctgtatcttaaactggttatgggtagtagggtgtccagtttttttttttattttttttttattgatcattcttgggtgtttctcacagagggggatttggcagggtcataggacaatagtggagggatggtcagcagataaacaagtgaacaaaggtctctggttttcctatgcagaggaccctgcggccttccgcagtgtttgtgtccctgggtacttgagattagggagtggtgatgactcttaacgagcatgctgccgtcaagcatctgtttaacaaagcacatcttgcaccacccttaatccatttaaccctgagtggacacagcacatgtttcagagagcacagggttgggggtagggtcacccatcaacaggatcacaaggcagaagaatttttcttagtacagaacaaaatgaaaagtctcccgtgtctacctctttctacacagacatggcaaccatccgatttctcaatcctttccccgcctttccccactttctattccacaaaaccgccattgtcatcatggcccgttctcaatgagctgttgggtacacctcccagacggggtggtggctgggcagcggggctcctcacttcccagtaggggcggccgggcagaggcgcccctcacctcccggaccgggcagctggccgggcgggggctgacccccccacctccctccccgacggggcggctggccgggtggggggctgacccccccacctccctcccggacggggcagctggccgggcgggggctgacccccccacctccctccccgacggggcggctggccgggtggggggctgacccccccacctccctcccggacggggcggctggccgggcggggggctgactcccccaccaccctcccggacggggcggctggccgggcagaggggctcctcacttcccagtaggggcggccgggcagaggcgctcctcacctcccggacagggcggctggccgggcagggggctgacccccccacctccctcccggacaggggtggctggcctggcggggggctgactcccccaccaccctcccggacggggcggctggccgggcggggggctgacccccccacctccttcccggacggggcggctggccgggcagaggggctcctcacttccaagtaggggtggccaggcagaggcgcccctcacctcccagacggggcggctattcaatgtattttctatttagcatttttggatcctttttgtaattaaattacaatttttgtcagctgtacataaaataatccatcaaagtgctcttcttttaagttagggtgcctctttcctcatcaaataaatgacttaaatataaacacaattttagcatataagatgaagagtgggaaatccataattcaacatgattatcaaatgtaatattggaatatattgaataaatatatttttaaatgtaattttaacaaatctcagaaaagtgttttgagtggcattctggtcctgccataaaattatgtaagttactaatagaaatggtctggattttgtgacagggcccacaatattgaaaatacatccacatatttaaatgcatagttaaaattaagtaagggcagattcaaatttcttgtcaccatacaaaatacagaaaacaccaaataaagatctttgcactgctggtcaggttaaaagacagaacatgccaatttaaattcaaatggaccactgcagctccacattacattaaggggaaaaataacctaagtcatcttgctattatagttgcagaaaatttcatacataagtaaatgtttctttaagtttatatgaagactattgttttaacaaaagcttgatacagcaagaaaagagactatggctttgctgagaatctgggtcacagaacataaaactcagcctgattctaaagtaaaggaaaagagcaaacgtgcaataatggagaacatggatagaatcctgtagctaccatgtactagtggtattaagctagtcattaagtcttcctgatattccacttcttttcctctacaaaggattataatatctacctagaagactattgcgagcattaagtaaggtggtaactcccaagagccattagactacctggtagatttcagtgggcttcaattacacatcagtcacctggaaagcttttaaaaatcccaatgcccaggccacatctccgaccaattaaatcagaatctctgtgggtaggaccccaggcaccagtatttcttaaagctcccaggtaattctgaatttgcagtcaaattgtgtatacttagaagagatccacatactaaaggtataaatagagaagatagggcagataccatttagtggagtgcggtagtggagaaagaaatgcaaaaccagccaggtgtggtggctcacacctgtaatcccagcagtttaagaggccaagatgggcagatcacctgaagtcaggagtttcagaccagcctggacaacatggcaaaactccgtctctactaaaaatataaaaattagccaggtggggtggcacctgcctgtaatcccagctacatgggaggctgaggcaggagaattgcttgaaccagggaggcggaggttgcagtgagccaaggttgtgccattgaaatccagcctgggtgacaacagtgagactccatctcaaaaaaagaaaaaaagaaagaaagaagaagaaacacaaaaccacagtgggaatcaggaggcagtccgtactatgacttggctcagatcatggagaagagggtaggaacagcatgtagtaactccaatgacaaatctctcccatcatgactttgaatcactctgctaggtctttacagtgtcagaaacatctgctttatcttcatgcccaatttgctttattccttttcctttctaatttagcatttgactttcataaaatgaatgcatgcaaaggaaagtctattttaggctatggagaatcttttattaatatagatgtacagaaatataagttaaaaggtttcctagatttcataaatttcaccatgctaaaattattgggccaatttacctttgcgggaaagaacatcaatcttccttccaaaacacgttgaagataaattgtcataatttaatcctttccattatagctcccctgttctattatgtgaaatatttaaaatataatttttctaaactgtccaaaatagaattatagcctataaattcttacaaaatcttcaagacaacaaacgttaaattccatgcctaagttaataaatatgtatgcttattcaattttttaatgaataaatcccaggaatcaaagaaatcttgagaaaattattatgctaaccctattaagtagcccaaaaactatttaaaatataaatattttttgaattttattatttttatggtagttgtaggaatagggtaataggaagcataatgtgtgctactaagtgttcacaatacatgaatgcttttcttttgcaattttttattttattatccttctagtttaacagaagttacagtgatgactacaaaaataaaagacaaattgatctatttccagtgaattttatgaactaaggcatgtaatacccatgatccaattgaaaatactcattatgtttctcaatgattgagataattgcctggactcaactctgcactttgctgcttagcttatgtataaatgatttgaaatgtcatctataagctacctcaaagctcctataattatgaaagttttataatcatatcagtttagaactagagcaatccagagaaatcatgtagctcattcaactcttaattcctcagatgaaaaaacagatttagataacctaaattttcaatcataaccaattagaggtagaggagattagcacccaggtctcaggcttacaaatccagtggttgtttcttatattatagcatgataccttcagtcatgctaaaaatttttttaaaaaagatttaacacctcattgattttagcgtatcagtgaaactgaacagatacattgctaattaaaggaatttaatgtaattaatattttttaaaaagttgcctgcaagactatactttcagggatcatttctatggttcattactagggaagtttccctgaatgtgtagagcaccgaaaacactcttcaggatactatccagaagaatttccccaacctagcaaggtaggccaatattcaaattcaggaaatacagagaacaccacaaagacattcctcgagaagagcaatcccaacacacataatcgtcagattcacccaggttgaaatgaaggaaaaagtgctaagggcagccagagagaaaggtcaagttacccacaaagggaagcccatcagactaacagcagatctctcaacagaaactctacatgccagaagagagtgggggccaatattcaacattcttaaagaaaagaattttcaacccagaatttcatatccagccaaactaagcttcataagtgaaggagaaataaaaggctttacagacaaggaaatgctgagagatgttgtcaccaccaggcctgccctacaagagctcctgaaggaagcactaaacatgaaaagatacaaccagtaccatccacgacaaaaacatgccaaattgtaataaccatagacactatgaagaaactgcatcaactaatgggcaaaatagccagctagcatcataaagacaggatcaaattcacacataacaatattaactttaaatgtaactgggctaaatgccccagttaaaagatacagacaggcaaactggataaagagtcaagacccatcagtgtgctgtattgagcagacccatctcacatgcaaagacacatataggctcaaaattaagggatggaggaagatctacaaagcaaatgaaaagcaaaaaaagcgggggttgcaatcctagtctctgataaaacagactttaaaccaacaaagatcaaaagagacaaagaagggcattacataatggtaaagggatcaatgcaacaagaagagctaactatcctaaatatatatgcaccccatacaggagcacccagattcataaagcaagttcttagagacctacaaagagacttagactcccacacaataatagtgggagactttaagaccccactgtcaatattagacagatcaacgagacagaaaattaacaaggatatccagggcttgaactcagctctggaccaagtggacttactagacatctacagaactctccaccctaaatcaacagaatatacactcttctcagcaccacatcacacttattctaaaactgaccacataattggaaacaaaacactcctcaccaaatgtaaaagagcagaaatcacaacaaactgtctctcagaccacagtacaatcaaactagaactcaggattaagaaactcactcaaaaccgcacaactacatggaaactgaacaacctgctcctgaatgactattgcgtaaataatgaaatgcaagcagaaataaagattttctttgaaaccaatgagaacaaagacaaaacataccagaatctctgggacacctttaaagcagtgtgtagagggaaatttatagcactaaatgcccacaagagaaaggaggaaagatctaaaatcgacaccctaaaatcacaattaaaagaactagaaaatcaagagcaaacacattcaaaagctagcagaagacaagaaataactaagatcagagcagaactgaaggagatagagacacaaaaaacccttcaacaaatcaatgaatccaggagctgattttttgaaaagatcaacaaaatagatagactgctagcaagactaataaagaaggaaagagagaagaatcaaatggatgaaataaaaaatgataaaggggatattaccactgatcccacagaaagaatactataaacacctgtaagcaaataaactagaaaatctagaagaaatggataaattcctcgacacatacaccctcccaagactaaactaggaagaagtcgaatctctgaatagaccaataacaggttctaaaattgaggcaataattaatagcctaccaaccaaaaaaagtccaggaccagatactttctattttgatagaaagtatctcaaaataaaaagagctatttatgacaaacccaaagccaatatcatactgaatgggcaaaaactggaagcattcccttcgaaaactggcacaagacaaggatgccctctctcaccactcctattcaacatagttttggaagttctgctcagggtaatcaggcaagagaaagaaataaagagtatttgattaggaaaagaataagtcaaattgtctctgtttgcagatgacatgactgtatatttagaaaactccatcgtctcagcccaaaatctccttaagctaataagcaacctcagcaaagtctcaggataaaaaatcaatgtgcaaaaaccacagacattcctatacagcaataacagacagagagccaaaccatgagtaaagtaccattcacaattgctattaagagaataaaatacctaggaatacaacttacaaggtatgtgaaggacctcttcaaggagactaaaatgactgctcaaggaaataaaagaagacacaaacaaatggaagaatattccatgctcatggataggaagaatcaatatcatgaaaatggccatactgcccaaattaatttacagtttcaatgctatccccatcaagctaccacaattttcctcacagaattggaaaaaactactttgaatttcatatggaaccaaaaaagagcctgtatagccaagacaatcctaagcaaaaagaacaaagctggaggcatcatgctacctgacttcaatctatactacaaggctacagaaaccaaaacagcaaggtactggtaccaaaacagatatatagaccaatggaacagaacagaggcctcagaaaaaacaccacacatctacaaccatctgatctttgacaaacctgacaaaaacaagaaatgcaggaaagattccctatttaataactggtgctgggaaaactggttagccacatgcagaaagctgaaactggaccccttccttacactgtatacaaaaattaactcaagatggattaaagatttaaatgtaagacctaaaaccataaaaaccctagaagaaaacctagtcaataccattcaggacataggcatgggcaaagacttcatgactaaaacaccaaaagcaacagcaacaaatgccaaaatagacaaatgggatctaattaaactaaagaacttctgcacaggaaaagaaactatcagcagagcgaacagacaacctacagattgggagaaaatttttgtaatctatccatctgacaaaggctaatatccagaatctacaaagagcttaaaaaaatttacaagaagaaaacaaccccatcaaaaaatgagcaaatgatatgaacagacactactcaaaagaagacatttatgcagccaacagacatatgaagaaatgctcatcatcactggtcattagagaaatgcaaatcaaaaccacaatgagatactatctcacaccagctagaatggcgatcattaaaaagtcaggaaacaacagatgctgcagaggatgtgaagaaataggaatgcttggccgggcgcggtggctcacgcctgtaatcccagcactttgggaggccgaggcgggcggatcacgaggtcaggagatcgagaccacggtgaaaccccgtctctactaaaaatacaaaaaaaaaattagccgggcgcagtggcgggcgcctgtagtcccagctactcgggaggctgaggcaggagaatggcgtgaacccagaaggcggagcttgcagtgagcggagatcgcgccacagcactcccgcctgggcgacagaacgagactccgtctcaaaaaaaaaaaaacaaaaaacaaaaaacaacaaaaaaaaaaaaaaaaaaaaaaaaaaaaagaaataggaatgcttttacactgttggtgggagtgtaaattagttcaaccattatggaagacagtgtggcgattcctaaatgatctagaactagaaataccatttgatccagcaatcccattatttagtatatacccaaggattataaatcattctactataaagacacattgcacacatatgtttactgcagcactgttcacaatagcaaagtcttggaaccaactcaaatgtccatcaatgatagactggataaagaaaatgaggtacatatatgccacagaatactatgcagccataaaaaaggatgagttcatgtcccttgcagggacatggatcaaactggaaaccatcattctcagcaaagtaacacaagaagagaaaaccaaacaccacatgttttcactcataaatgggagttgaataatgaaaacacatggacacagggaggggaacatcacacaccagggcctgtcagggggtgggtgcctgggggagggaaagcattaggagaaatacctaatgtaaatgacgagttgatgggtgcagcaaaccaacatggcacatgtatacctatgtaacaaacctgcacattgtgcaaatgtacaccagaacttaaagtataataataaaaaaagaatactgcacacccctcccccaaaaaaaatgttgcctgcaagtcattttcttgtaggttggatctcctttaagttcaataaagtatactgattgagagaagtattctaaagatgctttagaaaaatacgttgctatttacaatgtattacttaaatatatttgatccagcagcattgacatcactaaaagattgttagaaaagctgaaagtcagggtgcaccttaaatccaattaaacagtatctacattttaacggcttcccaggagccctgggaagctgtatattcgctcaagtttgagaagtatggcagccagctccagcccatccaaggaaagggacattaaatacaatctggtcagcaggcctcattgatcaaacatgtcagttagagacctgcacacttaatgaagatctcatagctgatctgaggctaagttagaatttaggcattccaactctatactataccatgttagagcattgtgtgatacttactgccccagagcaaatccgttcctccatacagatagtataagaagggaaagcaatctacacttcagactgctgcaactgttctggttccaagccatcttatactaaatataggactaaaacaaacaaacaaagggcctagctttcttccacccagggatgctaaaaggaagaaaagttaaggcagtttatatatgcaattgcaacatttcttgtgagtgtaaggtttgctgaagattttggtagagaatctttatcaatttaagaaagaattccctttgattttactttgtgctgagaattttgtttataaataattacttaatgctattagatgattttctgcaacgattttagatatgttttttctttttaacatgttaatattgtgatctgattttcaaagtttgagctacattgtattcataaaatgaaatcatagtgatattttcctacatgtttacctttttatttgttcactattcctttgtgcagaatttcctaacattattttttttcttctggaaataaataatttaggagtacccctggtgtatatctgttggtgttgaattatctcagcttctgttattttgaaaatatctttcatttgtctttatttgtgaggggcaattttcctggatataattccaggatataagtactctaagctcttgaaaaacacaagttagtgtcttccatcttcaattgttgccattaaaacgttagatgcagagcagcattctggggagatagtggagtaggaagcatgaagaaactgtctctgtacttaaacaacaaatgcactctcagaatgtttgatggaactattttggaactattgagtctatgaaaggcttgcaaattctggtaacgcatcgatggtaaatttcagctcttagcacaatagcagctcctcattctcaaccctcatccttctgacggaaaaatgtgcagggattagaagagcagcttgcacacagcttgtggaaagcagggtaccctcaaagcactctgtcctccaaatattaggaatctgtgatcctgtcagtgattgctgcttctgatcacagaggtgcagaaaaatgatgggcagccattttgttgcactttccccattgttgccaataaattccccttgagacgaagtgactttcagaatatttaaaggaccacaacatcatccatccattcctcatttctcatttttctatttttcccatttttgcagcaagacatagaaggacaggacattgaaaagcaatttcatagatgaagaaaattagaaagtgaccatgtatgctgaggaaaaggcacagattcagaaaagacctgagaagaccttaagtttacactttgaagtaattctcgttataaagacagcatgaaaattaaacaataataatgatataataataataataataataagcaaaacaccctgaaaaggggggaaatgtgatttccaaatttactacataattagattcaaatgtccagtttcaacaaacttcacgagatattcaaagaagcagaaaagtatgacccactcaaaaaaaaagaaaaaagcaacaataattgaccctgaaaaagatctaatggcagatatactagacaaagactaagacaactgcctcaaagatcctaaatggcatctttaagatatggagtcaagaaaataatttatttaaaaaatggaaatatcaacaaggagatgggaaatctaaaaagaaccaaaaatacattctagaaatgaaaagtacaataacagaaatgaaaaattcattagaagtatccaatggcagagttaagtaggcagataaaagaatcagcaaagtcgaggaaaagacaatgtaaataagtgagtctgaataaaatttttaaaaaatttaagaaaggtgaacagaacctatgaaacagagtcaagcatattaacttacacattgtggaaatcttagaagtaaaagagacctagatgaaggcagaaataacatttcaagaaataatggctgaatattcctcaaatttgataacagacataaatgtaaacatccaaaaggtcgatgaacttcaattacaatgaattcaaagagaacaatttcaaaacacattataataaaactttgaaaagaaaaaggcaaatagaaaatttttaaggcagcaaaaagcatttcatcacgtacaagggattctcaataagattgtcagcagatttctcatcagaaactatacagaccagaaggcagtgggcgatatattgaaaatgctacaagaaaaaaaatgtcaatcaagaatcctgtatcctgcaatactgtcttcaaacctaaaagaaaaattgacacatatccagatcaacaaaacctgagggacctcatcaggactagacctataaaatctattattttagtaatggtttgtaactttaatatttgtttccacataatttaagatattaatacacttttttaaattattaatgtaaaagctagtattattgtaactttggtttgtaactcagcagtttgttttatacagaatttaatagagtaatgcatttaaagaattatcagtgtatgttttggggcacacaatatattaagacgtaattttgtgacataaacaactaaagtggtgatgactacactgtaaataggcagcttttgttgatcaaagttaagctagtataacaaattagagtactgtaagtttaggacattaaaatgctgtccccatagtaaccaaagagagtagctatagaatatacacataaggaaatgagaaaggaattaaatgtttcaatataaaaaatcaattatacaaagaagaaaatattaatgcaggacatatgggacaaaaggtataaggtataaaggaaacaaacagaaaaattacagaaatatatccctctttatcagtaaccactttaaatgcaaatggattgaatcctctactcaaaaagcagggatttgaagaatgggttttaacaaaatgttccaactaaatgagatcttagaagatgctcactttagtccaaagacacaaatagattgtaagaaaaagcatgaaataagatagtccatgcacattgtaaccaaaagagagcagaggtggatacacaaatatcagataaaatatactttaactaaaaaagggcataagagccaaaagtacattagatatcaataagttttcatagaggaaaaaagtataataattataaacatttgcaaaccaaataacagaccatcaaaatatataaagcaaaaaatgacagatttgaagggaaaaatagacagttctacaataatagagacttcaatacaccatactgaataatagatagcacaactagacagaatattagtaaaaaatcagaggacttaatcaacagaatacaccaaaaagatctaacagacatatacagaacattctacccaacagcaacagcaacagcatgtacattctcctcacatccacatgggacattttcaggatagaccatatgctaagacaaaaatcaagcctcaatagattaacaaagacagagataatacaacctgtcttctccagccacaatggaatgaagttaaaaataaataacaagaaggaaaactgacattctcaaaaaagttgtaaaaattaaacaacatacttttaaacaaccaatggataaaataagcaaacacaatggaaatttaaaaatacttagatatgaataaaaacgaaatcacacatcaaaatttggggaacacagtgagtatagtgctaaagagtaaatacatactttcaaatgcttatattagaagtaagaagatctccaatcagcaacctgattttacaacttaaggaacaagaaaatgaagatcaaactaaacccaaagctagaagaaagcaggaaacagtaaaggttatagcagaaataagcaaaatagagaatagaaaaacactacagaaaactaataaaaagttgattccatgaaaaaaatcaagaagtttaatgaatttttaactagacaaactaagaaaaaaaagaaaaatcaaattattaaaatcagaaatcagagtggtgacattactacaaattctatagaaataataaagcttatgagactatagttaagaattctacatcgacaaattacatatcttagataaaatggatgaatttttgaaacaaaagcactgtcatcactaaatgacagagaattaagaaatctgaatagacctataattggtaagaagatttaatcaggagtcaaaattctcctgattaaaaaaaaaaatccctggtgtcttcactggtgacttccaccaaatgtttaatgacaaactaatacaaatattttccattattttccaaaaaatcgaagaggaaggagcaactcttagtagaaaagcttcacaacattggatttggcagtgatttcttggacatgacatgaaaggcacagacatcaaaagaaaaaatagacaaaatgaactacatgattttttttaattgtacatcaaaagattctatcagcggagaattttatccacagaattggagtctataattataaatcatatatctaaaaggaattaacatccagaatgtatagtgaattcttaaatctcaataacaacagcagcaaaaatctaataatctgatttttaaaatgagcaaatgatctgggtagacatttcttcaaagaagatatacaaatggccaacaaacacatgaaacaatgctcaacaatgctactccatgggaaaatgtgaagaaaaacttcaatgagatatcacctcacaaccattaggatgattataataaaaaaaacagaaaataaaatacatgttggtgaggatgtggagtaactgcaacccttgtgtactgttggtgggaatataacatagtattgccactgtggaaaatcgtattgtggctcctcaaaaaatttaaagtagatttatcatgtgatctgttaattccacttctgagaatgtacccaaaatattgaaggcagtttctcaaagacatatgtgtacattcatgttcatagcagcattattcacaatggctaaaactaggaagcatcacaacagtcccttactggatgaatgagtatcaaaatgtggtgtataaatacaatggaatattattcagccttaaaaaggaagaaaagtctaatgtatgctaaaatgtggataaactttgagaacatcttgctaagtgaaataagctagtcataaaaaataggttactgtatgattccacttagatgatgctatggtttgaatgtgtcccacaaatttcatgtgagatattaattgcattaacctccaatgcagcagttttcagaagtgggacctttaagtggctgattaggttaccaggtcaccagggctctgcctgcatgaaattcttaatgtcattatcatggaattgagttagttattgtaggcgtaagcttgttataaaacccagtttggccctctcttgatctctcttcctcttccaccttccaccatgggatgatccatcaggagggtcctcacgagatgaagtcctctcaaccttgggcttcctagcttccaaaactgtaagaaatacattttttcctttataaattacctacactgtggtattctgctatagcaatataaaatggttaagacatgaggtacttaagagtagtcaaaaatgatagagacagaaagtagaattataattacaaggagctgacgggagaagggaaaattattgtttaataaagatacagttcccatcatacaagaagaaaataattctatagatggattgtggtcatggttgtacaaacagtatgaaattatttaataccaccaagccctacacttaaaaatggttaggatggtaatttttatggtatgtatattttaccacaataaaaagttttgaaaaaaaaagttggatgtaaatctcatctttattccattgttgatcatctgtattttctctctggctgtctgtgagatctctttgtctctagcattctgtattttcactgtgctatatccaaatgtgattcttgtttttcttgcttttgtttccaatgtatctcaaatctttcatcatttctatacactatttcagctacttttatctttaatattgttttttttcttaccaccttctacattctctctttgagaaaatacaattagatatatgttgaattgtatttatctttcattgtttttaaccttttaaaaattttttcatctcattttctctctgtgctacaatctaatttttagatgtaccctcctctactgcaaaagtctttttccctagctctttgagaaataattaacaaacaaaaatgttaaatatttaaggtgtgcattgtgatgctttcatatatgtatacattgtgaaacgattactacaatcaagataattaacatatccatcatctcatatagttaccattattttgtagtgagaactcataagatctaccctgctagcaaatttctagtatataatacatcattattaattgtagccaaaatgaggtacaatagatcccatgctttattcatccttactaaccaaaactttgtaactattgactcaaatctcaccatgcctttttaattgttcctactgttcattttttcagcttaatgaaaccattcttttaaaaaaaaatttgattggtatgattttccttgccagaaattcatttttcttctctttcaaatataaatggccaatttttacagtcatttgtgcctttttcatgcttttgactccatcttttttggtttgttcaaagagattaatgtaattattttataatctgtatatagtgattttactatgtagtcttcacaaatttaatctgcattttaaacctttttataatgtcttatttctacacatgtagtattaatttgtttgttaaaattaatgttctttggagtttgttttttctgtgagaacaattaaagttgtgtattttatttttttccccacagagaagtttggtatttacatcagttacacacttaggacaccaacttcccaagaccacttttcattaaagtttacgtttggagccatacaagttagtgtgaatgagcgccccaatgccatagggaagatgactcatgattaggaaatcccagggagacactttctttttattaatttacctcttgctattgactggtgagactaagaaagccacatttcttcctccttcgccccttgagagaacagtcctaattcatctcagttttatatggggacaggccatggaagtcttaccagcatacagaaggtagtctgtatcattttgttaagtgaataaataagtgcttctcaaagagaagttatttccaatattaaattgaccacttcagcagcgcttattaatggtctttagaagttacattttcttttgcttcattagagtaagaaaggagccaatgagatttttagaaaaagttgaataacataaacattttctgaaacataaataaacatgtcatatgcagttaaatatgtgagcctttgtccacaatcctattctatataactagatgttctatatgtggaaactgtttcttaaagttgtgccttaagatggaatcaatctatgtgcatcacattttgggaacacttaggccatgaagatgttggttatacccaaaatgcttccccccgtcactaccacctgccttccttgaatctctgtgttgcaacattctctagaaagatgttaactcttaccatgagagaatgagcaatctgaataaacctttgcatgtccacactcagtgatataattcatctaacaataatgctttaggttacttttgattgctaaaacttgaatcaagtatttctgaaatggatagaagggtcctatgcctagggtgtccttatatatattattataaatggctctacagaaacacaaagttcactctgctatctctttaccatgcctctgcttcaatgcaaaaaatggcaaatttcttcagttcaaagaacaccagaatttagcttaagtaaaatgcctagtgtcattccatcagtaaaagaagtgcagttccctaactgaggtaaaattcaagtaactgtcagcggttcatattatctctcactgcatctgtaagattatttcaattgggaaaagaagtagcagaagatacttgtaaggctttttacaaacgcttgcaatttttctctgggaactttctactcttctgtctgtttgacccttcagagaaagttcatcttctaaaagaaccacagttttttgccacagaaccatcagtcttaccaaggctgaaaagcagccctgaatctctcccaccacttaaacttcattatctgcatattaaatgattttaggcaaagtatccccattttataaatttatttcttataataaatgcaaaagtgtgtatctgctttgagaacaaaaaattgttatttttttgtttttcctcattttgagggagaaaagcatgaaaaagaaaatgactactattttcatcttctattgcaattgcatggtttgaaaaccttaatgccaaatctaatagctgaatgttattaatatcccataccacaaggaagactggaaaacaggaaaagtaaagtaaaagtttgacagtttccattaaatgtgtgctgatatttttctgtaatactgagatttttttcaagataaacaatttaactgtatttcctaattttacacatgtaagatatatgctccttagatgccttgctatgaagaataaatgtgttcctattacacagtgcttgttatgaaagactctcacagttgtatagctcatttgactacatcatatgacactgtgccacatcattaatttatgcaattttgttggacgttagtctgttgaatataccacctgttgtgtatactgtttatctctgttactgtgtttgatatttcgttgctatgtcaaaattaataagttactattggtattttgcttcttcgttctactatataaattatttagcaatttctttaagtaaatgccacttaccacttttattacaataatgataaagataattcttaaaataataatgaacaagatgataaacataataattaacattttccaaagcattttcacatattgtattcacaacaatactgtcaaataagaagaaaggtctattatcttccttgcacagaagaaaaaatagattaagaattatcaggcaacctgtccaatattatataatttgtaatttttatacaggatactcagatttgcaggagaaattccacttcagaaagcaccaaattaccatcacattgatttccaaatgcctaatttaaatatctagatatctaaatatctgaagtcatttttcagaaaatgtgcatgtaattttccagagacatatattatagatagttattaagttcgaatataaccctcaaataaccaattcatctcaaataaatgtgaaaaataagtaagacagagactaacattgttttttagaaaaactaccagtttctcctgaggtaagtggttgctttctcctttcaatgtaaagagaaaaggtttagctctgaaactgttctgtaatgcttgggattcagaaatgtgcaagagtacatcctgctttcatttaggtgacaataaaaacagaaatgaagttaagttagtccatgcaattattatggaagaattagtataattatagatctcaaaggtatactcaacatctttttaaaaaataaattcagaatatgcatatagttggtaatgtccattcccagcaggaataactgaaaaggacaaatatttgaaatgtcatccttattaattgatggtttctcatactcagcttgagcagagtcaataaaaacattaccttgatgaaggtacaaacttataagaaaatatagttaatatttacagtagggagataaatgatcaataaaatccctatttgtttttgttttatttataatccagcctgcagttctgcttatcttttaagtagatagggtcactaaggaggctcctgcagggtgcaaggatgcctgcagtcaaactcaccaccctggaaagcaagcagtgctgccttcagctaaatacaatagagaacactgtcagttctatgctcctagaatattgtgaggcacagaaaaacaaattaggaaagggttggcactccagcccttacagcaacttctctgttgtttattcccttttatttctgtactgagtgcccaaggccgtgagaccttacctcttgcatcaatgtgacctggatgtgagacatggagtcaaagaagatcattttggaactttaaggtttaatgactgtcctattggatattggacttgcatggggccctagcccctatgttttggccaatttctcctatttgaaatgggcgtatttaccaaatgcctgtgcccccattgtatataggaaataattaacttgcttttgattttacaggctcataggtggaagggacttgccttatctcagctgagacttcggacatggacttttgagttaatgatggaataagttaagactttgggagactgttgggaaggcatgattgtgttttgaaatgtgaagacatgagatttgggaggggcccagggatggactgatatggtttggctgtgttccacccgaatttcatcttgaactgtagttcccataatccccatatgttgtgggagggacctggtgggaggtaattgaatcatgggggacattaccctcatgcttttctcatgatagtgagttctcacaagatctgatggttttataaggggctttgccctgcctttgctctgcacttctcattcctgctgcaatgtgtaaaaggacatgtttgctttcccttccatcatgactgtaattttcctgaggcctccccagccctgtggaactgcgagtcaattaaacctctttcctttataaattacccagtctcgggtatttcttcacagcagcgtgagatgaactaatacactgagatttaccttcaaaatatattttatatgaatatttaaatgtttctctgtatactatttttaaatttaatactgggatcaactttagtacagagcctattcatttatgttctttttaacacttcatgtacatattcagaacaaaaccaacataatctcaatcaatgcttcatgaaaaaagaagtaaatgcattatatggtcccaaggaactactgaattattcgtgcctagagttaggggcaaattggcaattatgttgtgaggcaggatacattcatcccgttagaaaacacactgtaagcttctccagccaatctatgaaaggattattttctgactgatggaagatcagtctgaaatctaacatcagactcattctaggaaaataaagtgggtcaggcatggtggctcatgcctataatcacaaccctttgagagtccaaggtgggaggatcgcttgaggctagaagtttgagaccagcctgggcaatataattagacccctctttacaaaaaataaaacaaaaaattagccaggcatggtggcacatgcttgtagtcacatctattcagcaggctgaggcagaaggatcacttgagcgcgggggttggaaaccatagtgagctatgatagtgccactgcactccagcctgggcaacagagtgaaaatctgtctccaaaaaaagttgaggaggtggataattggaactgaatactgcgatggttgattttcctaactcagttgaaaacaatttcagaggcttcaagataacgttctaattataggattgttttcagtgcaagatttcatgaactcaagtaactgttttctttaaggaacttaaaagaatctcccttcttttcaggtatgcagaagacatgtcaggatcttaactagtagagacatagggtcttgcaaaaggagggcccagggcaagtctggttgtattagcattactagtatttgtcattatgctggcagccaaactcctgctgacattatggttgtgtggtttggtacttcttcttacttctggctgtgaattagcaaatcagtgtcttatatttaaggtgcaaacaatatggctgatcacaaagagctggaactataattaaagaaaaaaagcaatgaatgtatttcatttgtttaatatcataataggtccccacttgaaaatcaaataatccaccttttgaaattgagattgagagacattagtagtttttgacaggggaaaaattccagaataaaaactgatttaaatgaaaaactaatcatgatctcaaataacaaaaatgtgcactaacacattctatttgtttaatttcaaatggataagctaataacacagctagatagataaaataagagaaaacttgtgcaaaactcttaaatgcccaccctttcataaagaactaaaagataagtataatttttagagtcggactactaaatactgtttctatagagacatttgaagattaataattacatacatttataaaccacaaaaattgaatagtgaaataattatgaacatacgaatttcactaagtaaaacagtatttgcataagaacattgaactttgtatataacaaatgagataataataaattaaataatacaaataagaagcagagcttcctagggagtaacaaaagaaaggttcttaacatttcactgaaaaatattcttaaaaaatagttctgggaaactgaagtattcaaaatgataaagtcattagtcctggttttctgaacaaacaacaaattaacaagatcaaaagcacaaacataatggaagagttacttggaagtgaaagataaatttctatgtcaaaagtaataaataacaggagacgaggtatatttttagagcataaaattatctcatgctaaagtttgtttttcattttttaaattttggaagcatacacttttcattaattagactaaaaggccttaaagtaaattaataatcaagtagaataataatatccataaatattatatgagtacgttctatttcctactatagcatacttaataggtgaaataattgagtcaaactttctcctaaagcatataatcaataaaaataagtaatttattatattcaaagttcacatttggaagaattttagtgctgcctgacagaatagagaaaaatcaaagatatgaagggtgtaacattttaggtgattagggaagtagagcaagggccatgatttaaaaagtgcaataattgtacaaaatatgtcttcctgtccagaaggtcaaaagtaggtaccagtagccaatgaatttcattgatctagaatctttgtatgtaagaacgatgcccttacacaggggccatgtggaagagttgattttttttttttttttgagatggaattttgctcttgtcactcaggtgggagtgcagtggtgctatctcggctcactgcaacctctgcctcccgggttcaagcgggagccttagcctcctgcgtagctgagattacaggcacccaccaccacacgcgcctaatttttttgtatttttagtagagacagagtttcaccatgttgggcaggctggtctcagactcctgacctcaggtgatccacccacctcggccccccaaagtggtgggattacaggcatgagccaccgcgcctggccagaagagatgcaatattttattcttcaaatactgcaactgaaaaaatgaaaagtttgtcttaaaattcaagaaatcaaattattcttcattttaaactcaatcaaatcatccccatatagaattttttgtcaatttgccttgattcattgtgacttttcagtgtttggctttccatttcttattctccctttcagagatacatacctattgatgactttgttagatatttattgaaagtattttatgtgctaggcaaaaacaataaaaacaaacctggtttctgcattcatttgagcttaaagtatcatcatcaaaagataccattaacttttaatgatgccctcaaagtcacatttttttcttcatcttttgcctcaaatattattttcttctatcttcctaaagtcatatcttcttttaaattatctttcagtaaatactattttttaaaaaaactttctaaataaacattgatgagcatttagttcatgtgctgttttgtgctataaaattttaaactaaatttgggtcagaggtctcttaaatcctttactattttcttattccattttgttagtaattatgcaattgtaattagaagacagatattattttttttaaaagaatcccattttccttataattccaaattgcctgtagtgctaacatatttcactaaacgctttacatatgttttcattactggtcttaatttacacagtgatgacttctcattacttattcctgaagtcacttttaatcttatgtctttggtttgtgattttgtttataccttcccccggctgaaccaccatatgttcaagaggtttagtctgaaatttcttgtctattcaatatttctttgtctgccttaacaatttttcaaactgttacaagttttccccttcatcttctgacacaagggctttatagccatgctgtccctttaatttgtccctgctttccagacatattcctcttcctgctctcttatcactagaatctcctttcttctgttcattctccttttaccagcattaccatatcctccatttttatccccagggttattgctccttttattttgttatatatttgtatcggaaggcaagccctaacctaggcactgaatgtgttgagtagcactattcattcaaaaacatttgtgaagcaactactttaagtcatgccttaaataagaatctgaggatataaagaaaactacgtcccaattctctaactcaaagtatgaataagcaaatggagaacccagcttgtgaaataaataattaaaatacaaatggcattaatttttataaacaatacaagtatattccttgggaaggaagtgaagaaaaggtagaggggttatggaagatatcttagaggaggatgtctcagtctgtttatgctgctataattaacgtctaagactgggtagtttataaagaacagaaatttttttgtcacagttctgggggctgggaagtccaagatcaagatgtcagcatattcagtgtcttgtgaagactcactctcttctgcaaagatagcactacttactgtttcctcagatggaggaaggtggaaaagcaaaagggataaacagttccctcacacctctttcacaagatctttaaatacatttatgagggctttgccatcatgactaagtcacttcctatatgtcccacctcttaatactatcacattggtgattaaatttcaatgcatgaattttaggaggacacattcagagcatagcagagggcatatttgaactggctcttgatatacaatgaatgggtaagagaacatagaaggtgagtaaagcattcatgacagtggaactagcatgttcaatgacaagtataaagacctgcgtgtattcaagtctacatgtagttgaagaacagggtgggtggaaggtgagactgcaaaggtaaatgtggatcaggtcatgagaagccttgcaagatacttatgacttaggttacttcttgtgagttatggtctgtaactgaaagatttcaagtcgaggggatatctgcagtgtaaagataattattgagacagtatggagaatggattagaggaggctgaaacatgagtcaggattagtgggaagtaattacaataattcagggaagaaatcacgggattctggaccaagacagtgagagtgttgatggaaaaacagtaaaatattagagattgtttaggaaagggcatcagtatttaataactatgactgggaggagaaagaggttgaagaaggtaatccataatgaattcaggcattgtccacaaggtgaatggtggtgtctttaactaagacatatttaatctacagtaataattgagagaatgctaaatatcactataaaataacaatttctggtaagtttatttatcttagataattaaatagagtttcaaaatgtgatgccaaggatatatctcctctgttcttccttaaagtgagatcttatctcacaactctgagacaaatttttaaaaaaggaaaaagctttgaaagttaaaggaacttgcttaaagtcacttatctagtaggtagtaaaactgaaaatctattctaattcttgcctagtctggcagttcttttaactatatggatgttatagagttgcacaagttgttcactgcacaagagtacaccaggccaagcaactaagtggggatcaaattccagcctgtgctccaccaacacatcctgaacactgttccaagtctgtatataaaatttgaagaggtgccttttccaaattcattgaaaagtcctctgataaccaagctctgcaccctcagaactttgtctccttaaaggaattgaattgttagaatttgtagaaaggtacaaagccaaatcttgaggtggccctctttatctgttgtatcttaagaacttgctgtatctaggtacacgttgatctgcttttggtaaaaagctaatgaaaactgtcccaaaatggaaagcgtgaagagagggagtggggagactactgagctagaaatttcctgtactctgttacaaatggtagttacatcctcaaattagagagtataggtaactaataataaaaattgtagtcatcctagtatgactaaaattaattactatatacatgtatatcttcaggggactggttctgaaactagatttaaaaaaatcatacccagagcatggctctagagcacatatacatagaatatgattcagatataacaaagaataaaaaatccttttctggcaccatatagggtttattttatattactataaatttatgactaaatgactatattaggctgaccttcaatatttcctgtaactttttcatcatgataaatgatgaatcataatgagaaaagtgatttcttctataatggtgtgaatatttcatttttactgaagaactataatcttcaatttcatgttgaataagaaatcataatcatatgcaacactatgcaaaagctatgaggttgtcctttattgtaccataataaaatccgaggttatcagtcatgcaactatagaagaatgtgcatcttcttttctatttaagacacgcttctgtgtttctccgaattttcatgactattattaaatactgacctatacacatagataaatatgcatagtgatcaaataattgggcataaaaatacacctaaaatgtaaactttagatttatgctattttaaatttttcatattctctttactaatactaatactctttactaatactaattaggctagaatctccataaccaaccaccactggaaattatactaatccttgggaatataagaaggactaaggagaccatcctttaggaagcacactcctgactaaatttggctgtccctctaacttgctttggccaatagaatgcaaacaggtgtgatatgagcagggatcttaaaatgcgcttatgcgacttggtggacttcctgcacttctgccatctgccatgagaggaccattccttgtaagataaaaatgcataaagcagctataaactcaagttgtagcctgaggtcaagcccaaacaatctatagcagaaagagaagctgcctccctctctgtctccctccctctcttccttccttttgctatcagagtgtgcttttctaatgatggaccaaaagggtggaaattgaagctagtactgccttgggactttaactaggaactaacatgctgtcacttacaccctttggttaaataagccttgtaacaaaactcaacatcactgggatggggaaatagaaactctcactttcatacattgtgaagtcacatgataggaggcagtaaataactgagaacatcatacaatccactgaaaccttttactaggaaaagaaattactgtgcctcatttttcaaggctaaggcagcaccccaggcccagatatgtgggcatatgacctgtgaaatcacacagggcccccatactttcaagggccttgcacttggtttaatgctctgctgtcaccatttttaaagtcttaacatttttatcaaggagcttaaatttatcattttgggctgagtcctgcaaataatgtaaatagatctgtcactattcatccctccccttccttctgtccaccctttctcttttgtgtactgggctctgtggttggtgctggggagatggtaaaaatgattaacaaggacttcacttttctatacgtaccagatgctatttatcatcacagataaaataacgactcttgagccatgctgtctgggattaaatttccttctgtcactcttcacctgtgtgacattgggaaatttacttaacttctttgtgctctagattactgttaatataacagggataatgtaattatagcctctacttcatagggcagtagtaagggttggatgcattaataaatataatacagagctggacacacagtgtgcaaaatataaataatgacagcattatcagcactattgttactattttgttctcaaaaaatatacttacttttatctcctttaacctcctctcaggcactgtacccatcatcctgtattttttatatttagtttctccctctttactggctgttctcccactgcctatgcattggcttaactcttaaggaagtttgtgtaaggatattttcctatctacttatatagttgagtgacttattccctgaggtatactgtgttttaaaatactgtgtttttttttaatttttgaaacattatatatgctgcttttaacaactacctttagaaaaatcctacatgttactgtctgatatacatggtaattaatctcaactctaaaatggacctattcatgctctctaaagtatactttaatacatgtataagtagagggacttctaactctaacactagaagataagtctaagaattcagaaaagaaaagaaatgaggggcaggctatcctagagacactttcttaagtagccttaatctgttaaaatatacctaattattgaattttattcttgttctaattgttttaaataatcacaatatctgtaagtacagaagagaacagaaagcacagcattaaaaataaaaacatattttagcatagaagaaactattcttcaatagtaatttttacatagaaaaatattaaattttataacattctagactattaggggatttttttgttgtcgttttcttttattgccttgttattcaaatatcatggcataggtagtattactgcctgtgaataaaagaacatctacttccaattctaaagtaaattatgaacaacaaatcttgctaaatttataatatggtcttcataaatgtaaataacttttacattaacaacaagaaaaaaaaatcagtgtctcagagcactgactctggaactgagcagctctgccagttataagctctgctaccttgaaaagttatttaaccctgcagtacctcagttatctctaaaatagggatgataataatccatttcttatttggaggatatgaggtttaaattagttgacatatgtaaataattagaacagagcctgggaattttaattagtagctattattattacccatggaatttcacaaagggaagattactctctctctctctctctctctctctctctctatatatatatatatatatatatatatatatatatatgttagtctacatatatatatgtatgtatgtatataaaaattgaactctctattaccaagtaatgcatgtctctagtttttagattccactttaatagcatgcccattgcattgttccctcacacctgcacatactttaaaggcattacataaacataaaatatctccagtctttccattgccagtgagataaagatcaaatgatatggcccctgcactattctccatcaaatttcaatgctttcctgactgtttaggtctgttctccagcttcacaaattttcattcagtttctcaaaggcactgtatttcctcctgccacagggctttgttgcatacatgcctcaactccaatccaaactcctcccctgccaccaccgcatcatccctgttaagtgaactcttttacccttcatggcttggtttaaaagtcagctcagggaagacttaacagaaagttgccctcatccctcctccaacataggtctatgctctcaaatcatccaactacatttcctttccagcttgtatttattgcctgaataatgtttatcttgcctgatggatccatcaggctttgtaccaaaacacaacttttgcataaataggctctcacaaatatttatggagtgatatacactgaccttttattttctacatcctcaatattttgcaaatgataccatgctttcaacgtgtttcagaaaacactgaatgagctcctactgtgtgcaatgttctagactaggaacagagcagtcaacaagacacagaagtccctgctctgtgaactacattctagttgaagagtttatactcagacaactatgcctgactataagtgaaaaaatttacaagaatcaaaacagagctcagccccatagaaacaaaagtaaagacaattctttttctgattaacacaaaaagacgtgttcctaatctttctataaggttttgttaaatatttctgtgtaatgttaaacttttgaactgcttgcattgcccatgtaattatttcataggtcaggattttcatacaatcatctcaaatccttttgagatcagaccctaaaaactgttgatgaacagagcaaattaatctaacctaaaataggctaaacctgaaaatctgtcccatttcaactatttttttaaaccctttaactcatagtggaggagttttaaaaatgtcccttgtgccactggtccagtcaaatttcatatcaaaaacccaactatctaaatataatatctcttttatatacctgaatgtccctatgttttagctaggagtataatgcaagtattatagtttattttaatatagattctttcttcccagaagttcaatacacattaaataacttatcacatgagatcaggcacactgtgctatggccatagacctaccattgatccaacaaaccctcccctgggtatctatgcaaaggaaaatgaattattatatttaaaaagacacctacatttggatgtttatcacacgattcacaacaacaaagatacggaatcaatgtaagtgtccatcaatggataactggataaagaaaatagagtgtatatagacaacagaatgcttttcagccatggaaaagaataaaatcttgtcttttgcagatacatgagtggaattggaagccattattttaaataaaatgagtcagacacagaaagacaaatactgcatgttctcacaagtgggagttaaataatgtgtacacatggacatatttggttggtgcaaaagtaactgcagtttttgtaatgacaaatacgtttgcaccaacctaatagaatttagaatgacagacaatggagactcagaaaggtggggggaatgggagggagtgaatgatgggaaattccttaataggtataatatacattattccactgatggatactctgaaagccgtgacttcaccactacacaatatatccatgtaataaaattacagttgtacccccatagatttatacaaattaaagaaaaaacttaatgcatgcttttttccttataccatccttgagtatttaaacgtaacagcctttctcttcattattaaatgaggatgatttacaatcactaggagtcttgttttggccatgagaggtgaattgattacttttctttgaaaaaaattttatccataaaacttatggttttctggaactgaataagtgtttgtttcatctattttttgaacacagaacagcaagtcaatctttatttgatggattatccttcatgattgctcagtattacatttcagttacaagttagatgctgacttaaaatcaagctctttgccagaaccttattactcatttttcattgtttccactttgtttcagagactttctaactttcagagccgaaagtaaacttataaattatctatccattcatttgtaatcaagttttctttcaatttttgatagtactttttagcaagactaggatacataatataattttcaatggataaaagtcaagggacaataaaatatttgtgcctacattatatatcttctttagagagaaactgaaaacagtattgagaagtcatttaaacttggaccatctaagatttgaaatgtgcaccttctttagctgctaataccttttttttttaagtaggaaattttcatttgctgaaattctgcaatttgaaattatttgtttctcttttatttaatactcactgagttcagtacatttacaactttttttttcatgtgcttggcataacttctgttcttggctatgtccccaaacttctgtaacaatggatcaggtctttaagtccttttaaactgaagtaaaaatagtttcttgacattcatgctttgtcagtaatgaattgcctttttttaggggagaaataaattttctagttgatctattgtaagacaggccagctcatccatatttgggcaggaaatatacttgaacttaattttagaaaactgagaattaatgagtgatataatatctccatgagaactccttaccctggtacatgagaaagccaatctaaccaaacaaacattaaggtatacttcttatatactcgatgatggctatacatgtatttattctgatgtgtctacaggagacgtcaaatagagattgctctctgtggactctggtttcactctaactcatagcctctagcaaagcctatcccctggcttggaatagaacctgggaaagaagtatgcacttctctgctacagaagaagttgtaaggttgagcatgaatgttcagaaactcctgtctgcattaccaaaaagtaatggagttttaggtaaaaactccaaggctcaggtagtttcaggttgagttcccattaggattttgacatgaaactgttatatttttaatatctggtgaaggagaacaccacttttctgagaaatgttccctcaatagaagaattctacttttaaaaaatgttgcctacctatctctgaaaacacacagtcgatggtagcagaggttctgtagctgtggaagaggacctagtgcttagaggaaaggcacccagtatagacacaaagtttgcaaaaatccaaaatgcccacggaacacctgccagtcaatttttagttgtgaagaattatgtttatataatttattacaattggcaccatttaccaattccttttcatgtattttattataagcaaataactcacaagcatttgaaaactttgacctgtatgattattaatgtcctccatctgcatagtccaatgttcaccactagtcatatgtgactgagcacatatattgtggcaagtgtgaatgaagaactaaaattgtatttttaaacttttaattaatttaaatataaatataataatttagctattggaagaattttaaacacgttaccaacaatttgtgtatgtggtctcctttttcatatgtaaattttatgaaatttaaatacaaacaaagtatttgtgatgacaatttagcatgtagatttaaatgttcattaatgtaaaatacataccagtttacaaatatttagaataaaacaaaaatgtaatatgtcattaatgtttttatactgttaaacatttaaatgagaataattttgacatattggattaaataaaatatgtttttaaattaatccaaacaattcctttttatgttttttagtgtagctactagaaattttaaaactaaacatgtggtttatgttatatttctaataaatggagccaccttagacaataataaatcatgtactctgtcaaatggtagagttccagatttaaacattttatgttagttcaaaattataatatcactttcaaccagtcagttagatcacttataccaaagcaaattggtggttcaatttctaaaattcttgtaattgcttacaaagcattttaggaggctaacgtattttcaaataaacatttgggggacctagttattctctcatcttttcccatggctcattttgttggcttacacagacataattctacaaactctacagcacaaatctattttgtaacatctcccatttcaccatggaagacatacttaaccacttaaatccttctgtaattatattatcaggtaacctatgtcattagttctcttgcctatagaaagatagaaccctcctgatttgagacatcctaagcatattctgccaaggaaatgtcatctgaacacactattttccacaaagaaagatggaaaattgctcaaatgttcttttcaaactactcattacccttaaattagtttatagtgggtaaaaataaatagcaataattttaaaaataagatactcttccaatctaaaagctatgacttaggttgaatttaagaattgaattaaagcatagcaatagctctccaaatacaatgttgccagatgctgactttgagaaatggagtaataaaatatctgagctctcctccagatgatttagtagggtccccttaaaaaaagttcatgtcacaattaattgctccctagttgggcaagacacaaggtggttcagaaagagatgatgtattgcttatgctccatttttaatttatatgaatagctgaacagatgccaggaaaaagtatatttatgcatcaagataatttgtttttttaaaaggtctagaaaattaaccaagcatttttgcaaaactttcaaaaaagaaaacgtagtcaaaggcaagtacaaaaagaaatggatatatttcatgctagcaaaaactaattcaaaacttctaaaaataggtacagattgaacaacataaaacatatgggagactctcactcagtagatccctatgaaaacacaacaatgttttccaaactactgaagcaggtgagtcaagaaaactgcttaccggcacaggttttaaaagaacaatatttgttttgctgttgttttaaaaactgatgcttatataaatttcgtttattcttttagtcattcatttcattcatttatttctactcttttcccttaaatctctatatcaggagtcatcaaactttttttttcttttttttttttttttttgaaatggagtctcgctctgtctcccaggctggagtgcagtggtgcagtgttgcgatcttggctcactgcaacctccgcctcccgggttcaagcgattcccctgcctcagcctcccgcaaacttttttaaataataaacattttaggtttgaggttcttattgtctctgttaatattactcctctgccatcatagcacaaatgcagccagtgacgatacatgaaagaatgggcttggctgtgtcccaataaaactttatttacaaaatggactatgagagatgttcagatcctagagtcacagctggctcaccccgatctatattttgaacaactgaccttgtcaatttaatttttattatcataatattttcttgagtattctcctgaggtagatgagtacagtgtacatttttagttttgcctgcttgactttcattcctttttttctgttaatagatgttccttggggaatcctgctttcaacttttatccattttaaatagctattggagttaactcagggatgacaagatgaagcaaccaggacatcagaaccagtaatgctaactgcaggatttttgtgaaactctttggagaaaaagttcatcctctttctactagaaactaataagatgtatgtctagagccaccgataatcatcatgtttctgtatcaggacagcctatatgagaatgtccaacacagaaccaagagatggactgagactcaatcctgatggcatattacttaatctcctggatccacctgtgtttgaagtcagaatcatttcaattgcataaaagaatgcattctctttttgtctgaattagtttaaatttttttctgcctcttgcatgcaacaagtactaaaaaaaaattgagaaattaccataatatcttaagccttctaagtcctagctctgggattcaaacttcccaggtaagccttgacttcttcatctatatatttaggaggccagagatagtaacattgtgtccttttgtccacatgttctgtcctaggcagagttaattatatgaataaaaggaaaacagtaagactgtaaagctattcacatctcatcaaatatgatgccctgtttgtatctgttcttccattggaaaagttactcatctcacactgctctaaataatttcaaaccttgcattatgaaggagaagacaaaaactgaatatgtataagtggaaagaaatgctatggtccatttgagaatacctaattaacatttccagcaaattttgcttttaattttattataatgctttgtgctcacatcattattacagtaactaaacccagctgactttgctattgaacttcttaacataaatatacgtaactatattttggcttttctctgataatctcagatacatactattagtttctatagacaagtcaggatgaagattaattttggagaaaaattctagtcacattaaagtctaaaatctaataggagtaattcttgcatttgatttcacatattatacaagtctatcttttaacaaccattatattcatcttctttcccaatattaagctgtattttccttgaaggtagagaggtatatcactagtttttgcccttgcaggaactatcatagtttctatcatgtagaaaggagtcagcatccatttaattgaattattttttatgagacacattcatattttttttgcctgcatccatattataaagacttggaaggcaagcactaaccattttaaatgaatgagataaacaccctccttatctcctgccagtatgttgctgtttcattcagtttccccagtaatagaccagagatggtctagattcaattccaggtactggaagcaatggtgaaacagaggaaaatgtaaaaaaagcaatggtgagggagaaaagtggtccatgaaaggaaacacagtcagtaaacagagtgattattaagctaatgaagagggtgacctgagcttaattccactgagccaaactttggaaaaggtggtaaatacatttcagggaattttaccacttgaagcatggaagctagagtatttatacagcaagtccctgcagtcattgcttgagggctgatccatagggaggtaatttcctctcatttctactctccttgttccaggaaaagcctttaagtatagaaatggtatgggagctgggcattagcctgggcaccccaaaatcttgggcctgagggattcaggtggtgcactaacagagggcctgctgtatccatcttgcctctcctttttccacctgtgctgtgcaatattctaaaaaataattattaaaaaatctaacttactaagcttccttattcaaaaaccttcaatgagtctcactttggttttatgaaatctaaaatcttccctggattatcctttttttgtcttctatgttcctctgtggcaaaaaaaaaaaaaaacacctgttcgaaaataaataaccgaatttcagatgcatgtctgtttggattaaagaagcatacactgaaacatattagtgactttccaatgtggtaggtttctctccttgtccatggtacccagagaattcaccaacacacagaaggtctccaatttctactgaaggcataagtatcataatattttcaaactatttaaagtaccatcaaaacttgtacaagattcatacatctagtgtttgttgagcaatgttacacttgaaacctctttcgtgctttgttaaataaaaatcatatttaattacctcttggattatggaaataaagaagtttattcaattattattttaataaacataattcctacttaagatacctaacagcactagtccataatcctaatgaacattgctaataatagcctgacattttaactatattatagcccccttttctcttctctttactatataatgtaacattccttttaagagctgaataatattcttaacttctactgccaaatttataaacatgtcttgctacaattatttataaagaataacagcttgctttcccaagcaggcttcttgaggcaacagtgcatcggatttttccgcaggcttgtgctgtagaaacttcatggtctagaggagtttaattgacaatagccgttccatgtgtgttctctggccctgcttgacctgaagcagcttgtttctccttccaagagctagaggttatggtggattgtaatgaattgatctagcaagtattaatagatcaaccagctatccctctaatctaacagtagtaatccacttaaccatctgctgactcaagtaggacacgattcattattgaagaaaataatgttttgtgagtcacattttaaaatacatttttggtgacaaacataattgtgggccattttgaaaaatgaagcaagcatatttctttaaatataaattccatttttaaatggaattctgttcacatatctccagtcatctttctgtgaatatagataaatagaataatattaaacaccacgttgttatctgacctaattttttctcttcgtacaccaccaacactcttccatgtcagtaaatacagctcacatcatttcaatgactgcatattatttcatagtataggtataccttattcatttaaatgttcacttttgatgtttatattgcatgcaatattatagatttgtaaaggtacaaatatcttagcaaatacttttgattaacttaaaaatagataggtaatttactatgtgccagcaactgttccaaaaactttatcaatattaacttgcttaatccttataacagctctacgaggtagatactactctttatttatttctacaaatgaagaaactgagttgcagagaggctaggtaagtaattcaaagttacacatgtactatatgaaagatcttgttgtctaacccaggcatcctcacctcaagatttgttctcttacccactgtagtaagttagcttaaggtatttatgtctcaatattatgctttacatttagttattatattaaattcctaaaaatcttatgcctactatcaaccattccaccagaatatctgaaccaatttacaatgcctccagcaatccatgcccagaataacattaatatttattatgaaacttttatttcttgacatactgactggtggcagaggctacttcatacaattttaatttctacttttttactttctagtgaggttgagtattctttgatatatctagtagtcactttagatgggtatgctgttgagataaatgagcaccagtagcatggttttgcatccacttaaaagatttagtacaatcatatgcatataactatacttaaacttctaaatcttgcatatagttcaaccataggccaatcatttatttgatgatccacagagatgaataaagtttagtcttaaaataacaaaaagaatattactaaaattatagcattctattatctagcttttttaaaaatagtgatcctcatattatgcaacttttaaatctgcatacaaaaatattccatggacacatgttttctacctctaatttgaatattcaccctgttcactcatactctagcccagcattgttcaatagaaatataaagtgaactatataggcaattttaaattttctagtagccacattaaaaacaggaagagtgacatgtaaagttagttttaatgaaataatttacttatcatttaaacatataatcaatataattaagttatttaaataaacatttaaccaatatgtaaattaatgatatatttttcttctttggtactgagtctttgggatccagtgtgtattttacactcatggcacatatttatttggactagccacattttaagtaatcaatagccatgtatggtcaatcacattgcattggacagcacagctctagtcctttttacctccagcatccatccctcattattttcctttaaattagctttttagggtattaaaaagatgtttatttgtcagcaaggacagatgtttccaggaaactgtatgctcttattagtgctgtttgcacatttttatctattttgactcttggcagggttttgagataataaatttatagcatcattcttcttgcagtattatctgctccaaaatctatatacaagctttggcattcttttaagacctctcattgaaaaacactaagtaatggccctaggtatgtcactaaccagctgtgtatacttgagcaacccaagctgcctgttttcatctatgtaggaaatacatagtccaagcaaaacagtgaattgggctttagttcctaagatcctttcagggatcattgctgacgataagctaggtggccctgagaaagtcactgaagttctcattttcctcatctatcaaaaggagatgatactaacctattaaaggtgatgttagaacagaagtatatatgtttactcagtattggacactcagttgcatttatcatttatgaattattgcctgcaaatttcttcatctgcaaagtgagtgttggatttgaactagaatgctctccaagatcctttccaattaaaacattaaataatttagtaaaatttatggaaacaatagcatgtggatgatagaagttaatctaaaaaaaaactaaaaagcttctgcataccaaaagaaataatcagcacaataaacaacaacctacagaatgggagaaaatattttcaatctatatatctaaaagaaggctgacatccagaatatataaagaatgcaaacagagctcaacaagaaaaagaaaacccattaaaaagtgggcaaaggacatgaacaggcatatctaaaaagaaaacatactaacaggtaacaaatatatgaaaaaatgctcaatatcactaatcaacagagaaatgcaaattaaaaccataatgatataacatctcacatcagtcagcatgacttctattaaaaaaattaaaaaaacaacagatgttggtgaggatgcagagaaaggggaattcttatacattggtgaaatgtaaattagtacaacctttatggaagacactatggagatttcttaaagagccaaagatagaactaccatttgatccagcaatctcattaccgggtatttactcaaaggaaaataaatcattttaccaaaaagacatctgccctgttatgttcatgacaacagtattcacaatagcaaagtcatggaatcaacctgagtgtctgccagaggatgattagattcagaatgtggtgtgcataggttacacacacacacaccatgggattctatgcagccataaaaaatgaaataatgtctttgcagcaacatggatggagctcggggccattatccttagtgaaatgactcacaaaccaaaattcaaaaaccacatgttctcacttgggagctaaacaatgggtacacacggacatacagagtagaataatagatattagagattccaaatggtgggagggtagaaggagagtgatagaagaaataccatctattgggagcaatgtacattattcaagtgataggtgcactaaaagcccagatttcaccactacacagtatatccacataacacaactgcacttatagccctaaatccataaaaataaaaaatgtgatttcaaaaaaagaaatatgatgtgatacaatggcccaaaaaataataaaaatgaaataaataagattttaacaattcctccctcacttctcaccataggagatggcatgttagttttgtttccttgatgggtatacaaacagcataggtattggggcaggaacagcaggtttttgtatcaggcagacattgagtagggtacttcttagaggcaacagtcagggatgatagtcaacatatttaacaactgttaaattatgggcatcaatcaatgtgaatagctgctgcacccaatcaatgtgaatagctgctgcacccaatcaaaattataagcaccaaccaatgtgaattatgttaaattatgggtgccaaccaacgtgaatcatgttaaattatgggcaccaaccaatgtgaatagctgctgtgcccaatcaaaagggaaggaagttccatgtgaaccacctattatagacacacttttgtgtcagcatgagtatcagcactggcagaaaggcaggtggtagggcaaagattgagctctgaagacttatttcatgtgtgacatcgaatccgtaacttaaactcacaacattgtgacattctcatctgtaaaatggggtatgtttgcaagatagatactacccaaagataactaattctaggataaagacattttaaacaataaatctaccaaagatatctatggtaaaaataagtttggttggaacttatcttgaacgaaaaactgaaatcatttatttcaacgaatacttaggaaaattaaaatttccctagtattcagaacaaagaataaataattgattgcttgaagaggaagaaatttgggttattttgcccaccaaaaatgtacaataacatattttccacttcagtgatgagtctgacagcacatacctacaggtcattttgaaaaacagtattatagatgttcatcagttattccaaggactgctcttaattctttgtcatttttatcattctcatttgaattcctattgttgtggattaacattatatttattttgtatttttcaaaatttactatatctgatcattggttagaaaaatcaacaatacacaggttcaagctattgtgttaaacagagagtgctgtttaaatgaaaactaactttattagtcctctcttcactagttaccatttcaatccttttaaaagtttttgcctccatgagaaacttcataactctaggcatgtggaaaacaaatacttatgtaataagaatcttgtagataaatcacttgcgaacctagtgaggaccaaataaaataatatcaattagaattagaacacagtaagagtgcaataaaagccacatgctagtaatcttccatttgatttcactgtgtagataccagtctttgaataccaagaatgcacagtaacactaggaagaaagccatgtgagtgtctcttctcttgccctctctatggtgacaatgtctctaactgccaatgagtcagctaaaaataattttttaatacctcgccatttgaccataaatagctatcctatgcaaaggcattttatggccaggcacggtggctcacacctttaataccagtactttgggaagccgaggcaagcagatctcttgaggtcaggagttcgagaccagactggccaatgtggcaaaaccctgtctctactaaaaatacaaaaattagccgggtatggtggtgcatgcctgtaataccagctactcgggaagctgaggcaggagaattgcttgaacctgggaggaggaggttgcattgagctgagatcacgccactgcactccagcctgggcaacagagtgagactccatctcaaaaaaaaaaaaagcactaaaaaataaaattaactttataattttttgtagcttacacatgttacaattccacaaatatgtataactgaaatatattcaagatctatgtactataaaattccatttgacatcttacacaatttttataccttaacaatcttcatttccttataagaatttccttataagaatcattttagtatctgtagtttatgtttgcttcatattttttaagcatctcattaaaaatcacctattattttttccttcatttcacccttggtgaatctgacgattatgcgtctttgggttgctcttctcgaggagtatctttgtggtgttctctatatttcctgaatttgaatgttggcctgtcttgctaggctagggaagatctcctggataatatcctgaagtgtgctttccaacttgattccattctccctgtcactttcaggtacaccaatcaaacgtaagtttggtcttttcacacagtcccatatttctttgaggctttgttcattccctttcattttttttctctaatcttgtcttcacgctttatttcattaagttaatcttcaatctctgatatcctttcttccgcttgattaattcggctattggtacttgtgtatgcttcacgaagttctcgtgctgtgtttttcagctccatcaggtcatttatgttcttctctaaactggttattctagttagcaattcctctaaccttttttaaaggttcttagcttccttgcattgggttacaacatgctcctttagctcagaagagtttattacccaccttctgaagcctacttctgacaatttgtcaaactcattctccatccagtttgttggttttccttttaccaatcaggcccctctgctgcaggtctgctggagtttgctggaggtccactccagaccctgtttgcctaggtatcaccagcggaggctgcagaacagcaaatattgctgcctgttccttcctctggaagcttcgtcccagagggccacccaccagatgccagctggagctttcctgtatgaggtgtctgtcgacccctgccaggaggtggtttccaatcaggaggcacaggcatcagggacccacttgaggaagcagtctgtccctttgcagagctcaagcactgtgctgggagatctactgctctcttcagagccagcaggcaggaatgtttaagtctgcaaagctgtgtccacagccaccccttcccctagttgttctgtcccagggagatgggagttttaattataagcccctgacttgggctgctgcctttcattccgttaaagtgaatgctatgaatatatggatctctattttaaaaaaccttccaaatcagagcagatggccgatttatctctaacaatattaaacataatggtattttactactatgaaattatataggcacctttcaaggttcatttttaacaaagttgcaagagtgttgggaagtgtagcttcacattaaaaaacagcaaaagaaacaaacctttgggaggaaattgtgattcagttcaccaccactattatgtcttttaaatgaactgataaacatatgcttaaacacattgctgtctaatttagttgttctttcagacaaactccacgaatgttttaaaaatcttaaccaaccacattaaaagaacggccaggattatctaagtggggaacatgcttttccatcagtgtcctattccagaactgcactcctttctggatgctctaggaaagaatctgttaccttgccttcagcagctgctagaagctgcccacaaatccagtggtgaccagctgagtattctgcataacgatcactctgactcttcttcttccatcacatctccttcaaatctcctgcctacctctttcacttacaagcatccttgtaattacattgagcccagcagataatccaggataatctccccatttcaagatttgtagcgtaatcatatctacacagtcccttttattcagggaagaacaggttcggggaaggacatggacatctttgcaggaccatttttctgcctaccacaatcagataaatgcagtgctcttatttcttctttcatgtaatcttaggtctaacaaaccatactcattttcttctaatcattaaattgatgattcagagtttaattcttgaaatactatttatttggctttcaggaccttgagaaaacaatctttctttcttttttttttttttttttttttttttggtctctctctctctctcttttcttttttttttaaacatagtctccttgcccaggctggagtacagtggcacgatctcggctcactgaaacctctgcctcccaggttcaagtgattctcctgcctcagcctcctgagtagctgggattacaggcacccaccaccacaccaagctaacttttgtgtttttagcagagataaggtttcaccatgttagccaggctagtgttgaacacctgacctcaagtgatctgcctgcttcggcttcccaaaatgtttggattacaggcatgagccaccacgcctggcagagaaaacaatctttctaatgtctgccccacattaattctaatttgtacaatttccatttccttaatttgtataccattgtactacctgtggtccatgtttgcctcatattttttaagtacctcattaaaaataacctctcaaattctgttaaagtgaatactatgaatatatggacctgcatatgaaagaaaattctcccacatcaaagcagatggcccatttatctctagcaatattaaacataatgatattttggactgtgaaattatacagacaccctttaaggttctatatacttttaaccctgcaccccctttccatatctctgtcccagaacttccattaggttcttacctttctgtgaatcaaatgcaagcgagggctgggtgcagtggctcacgcctgtaatcccagcacgtgggaaggctgaggcaggtggatcacttgaggtcaggacttcgaaaccagcctggatggcatggtgaaaccccatctctactaaaaatacaaaattaaccaggcttggtagcatgtgcctgtaattccagctacttgggaagctgaggcatgagaatcacttgaacccaggagacagaggttgctgtaagctgagattgtgccactgcactccagcctgggtgatggagtgagactcagtctcaaaaaaaaaaaaaaaaaaaagcaagtgcaaaatgcagaagtgctaggaatcctggtaaaatactccaaccatttctttctctcccaggctgctggagagaattagtggtagtcgccacaagaaatgaaggtttatacagaaatctcagacacagaaaactcagaccaattacaagaatcctccacacagccaaggagtcttctgcacatccaaaaaatacatgggaaccccagaatttgtaggtttagagggtcagctccagtgaatgcaatacaaatggagacagtgaattctgaaattacacctggttttctctaactaatgcatcttctcctttccttagactccaaatgcagcagtttttgctaaggatatgtaatctataaggccagagaacagttctgttcatgattgtaaataactaaatccaggtcacctgcaccctgcaccacatcaggtaattcagcctacacagaagttgccctgaaagcaagaaattcctttttgctattgctttcatatattgtgccacgatatattgaagaacctaaatggtggtggattttggttatttgaggttatgtatgatttttggaaggagtaaaacatctctcagtgtcatacccagtcaactaaagataaagctaagcaaacagttttgggatagaagatacctacagcataagacagtattcatttttatcctttttttttttttttttttttttttttttgagacagagtcttgctctatcacccaggctggagtgcagtggcacaatctcggctcactgcaagctctgcctcctaggttcaggttcacaccattctcctgcctcagcctcccgagtagctgggactacaggcgcctgccacaaggcccggctaattttttgtattttttagtagagacggggtttctccatgttagccaggatggtcttgatctcctgacctcatgaaccacccacctcggccttccaaaatgctgggattacaggcgtaagccaccgcacccagctatcctatggttttaaaagcagttccaaaaagaatttaaaacaccatttcaacaactgtggtacatttggggggaagaaagtaacaagcctccctgggcaagtacttttaaggatagctctcatgtagctatggggatttggttttattaaaaaccaatatatcaatgttattactgctccgtcccacccacaaatcaagataaacattttatagtctgtgttttcagtctaagatagtttaaatatgtggagtgaaatgttttaaatgaaccatttatttgatgaaaacattaccacacgtatctgcctatatagcattgtcataaattgtgcaaaacaggtatatccaatacagcaagaattttggataaatgtcatctctagtgcccaaatttgcccaacatttggtcagataagtatttaactagataaatgatttattacaacatattactaatattaaatgtacaagtacaaataatatttgtaaaatatgcaattttattctgaaataaataacaaacacaagacttaaattttaacagtttggtcctctaatggcttacatggttcatgcatgattgcaattttaaatgggttgggaatcccaacaacctgtaaattgaaaataaatttgccttctgatgatggttaaattgtaaaatctctacagactgaaaagattgacttttagactagctagaattgacttgaaactaagggaatctattactatatctaaagaaagaatgtgccaatcaaaatgttttggtggatgaacaggatgaggaaacggggttattcagccattaaagcaccaaaatctgaaaagtagaaagactaaccatggcactgcccagacaaaacactatctgagagaataggaactgcagcacagtctatggggcaggtgtagccaactgcagtcagaccattttagctccctaccattcaacattcaactcacgcaactaaactcctcttttccaattcatgaataaattcactagaattctcatgtctcttttcatatccttaaagattataattaccattatggaattaaaaatctatattctcatatcatactttttgaattatgtatccctgggaggtcacacctaggatatgaatctgttctcagtacactgaccaaaccatgtttctatgacttaaagattaaactactactaccacactgaaactactaccgagtgggagcagctcaaaaccagtggatcaggagagttgaagatttgaaggagagtggttaaagaaaggggaaaattatgtttgctgaatagaagggtaggagaaggtgggaggagaaaaggagagattttatgaggtcaaagaacaggtattgcagcggtcactgagtaattcagaatctaattgcttttcaacagtttggaccttacagaaatatgtgagaaaatataggaacaatctttttgtacagccttccctgagttcaattaattcagtcagaatgtagatcatttacttaaataccgaagtttgacaaattaaaggccaaggtgtttgaatcctggaaatacattcaattccccccaaaacatctcttaataaaaagtgagcaaacaaattgaatgcccttttcaatcatttcctattagattagtaaataaggaataagtaatgccatcacttgtgaaggttatcacctccagtatggtaattaccaaaatgaaaactggagtaaacatggaaaggaaaatagacctaggaaaatatgaaagtagaacctggtatacatccaagaaatcttatcacatattggcatggcaaaaagtggtcctttaggaaattctgatttcatttcactctaatcatatgtgatatatccaaactgaggagacagtgggtgtaaatatattgctagtattggcatctcaaacagaaagaatgcaaatatcatttccaataatccaagcaagtgtttaattatcttacaaaataaccaaaaaatgttttcaaagaatgtcttataattatatagcaaaattcttctgggggtattttttcttaaaatgttctagacaccatataacatattaaatatttttccatgtgctaaaaagatgctagcaatgagtagctcagaaacatatatcttgcctgttccctaagtcacttattcacctgcctaagttgattctgcaagtgagcgttaataaaaaaaagacagacaagcgatggttgtgatgatgattcttgttttacctatttaaaagaaaatctcattagtttggatttgcttcaagtgtgaacaaaaatggaatcagtctaaacaaaaagattctgatgataccaccattctaggttaaggtcattacaacacacacacacacacacacacacacacacacacttcagatttctaaagcaagatgaatgtcttgctatacaatgttttcttgaactgtgaaactgactattcaataaaaatctgggaataactataactatcaatatttttataaatagaagaggcacttatttatgcaaaatgattgaagtgcaacccttacttcaaaaagaatatgatgatcataggtactctaatttttttggattccattaactattgcccattctttaaaagattctattattttagatttaataggttagattgctataaatctgtttatttttctggaaacctacatatcttactgtacttattttagtttgtaaatgtcattatttgaaatgttgacttttttttatactattatctagtgtgttataaaaacattaataaaagttttctgggaattcaattggtctatcaagtataccgtataaacaaagtacttttgtaagcactgtgaggcataccaaagtgctgaacaatctatatcctttataacttactttgtgttttaaaacaaagtaatgtatgagtaaagagacaactaatgtgataatgctttatattttataaaagaaccaaccgattatctaaacataatagtctaataacccaaaatgcaagccataaatactctttgactacacatgagttttctgcatgtggcttcatagatgcagtctgagtaacaataacaagtttatgcagatacataataaaatgaacttaatgtagaatacatataagccaacttcccaaaagagcagtaatgccaaagaaacccagttttaattataaacatatattaacaggtttcctaaagtggtttccattttaacttttggaatagcaaatttaaaagatgtaacagcatcttttgctttattacacacctttgttattagtgcaacaaaagaaagaacagtgtgtaaattcctggagtacaaccaaatgagtcatctattcaatttgctttaattttctttagtaggagagtcagggaactattacaccatgtgaataaggcttacatttttaaattgtatcttcctcattgtcagtatctttctaagattttctgaatcaaataaaatggctgattcatgctacattgcatgaatatgaagttctcctattaactagcatggactgatggtttacattcctaatatgtccaaatgacttcaatatcatttttataatgcaattacatattaaaatgcatattttcacattgataatgccaacataaacaaacctgagaagtccctgttaaagttggtatgttccaattgcctgggcttatattcaaggctttgtgcatagtaattgactgcacaaacaattcatcctggaagagttcttcatgcctcttattatccccaaatcaattgacataatttataacatattctcaattaaagttaaatcagaaacctgaaacctccaactctagattggtttactatgtagctgttatcagtagcaacattttaaatatttcaaaagatactcttgaattatgggaaatacaaaacaaaataaataacttgcttagaaataataataaaaaattagtttaagatgatctatgtcacttcccaaagaacagacagaaattattttagcaacaattttatgtttttgtttttctgtttgtaaatttgacttccaaatgcatttattttttgatagcaatgagtatgtaacctatattactaactgaagaggtaatttaatgtatttattctactttaagtatatacctttataataaagtattaataacttttgtataaatatatatttacagttcctagagggaaaatctcaataatgtcattgcattttgggttggaatcttagttaattcttgtattgaaaggtataaccaaaaaattgctaattcaggctgaggcaggtcgatcaggaggtcaagagattgagaccatcatggccaacatggtgaaactctgtctctactaaaaatacaaaaattagctgtggtgtgtgcctgtagtcccagctactcgggaggctgaggcaggagaatcgcttgaactcgggaagtggaggttgcagtgagccgagatcgcgccactgcactctagcctggtgactgagcaagactctgtcaaaaaaaaaaaaaaaagagctaattcaaaaataagttatagtccatatatgattttgaaattgagctttttagaaacaaagtcaaacatgttttttctagaaacaattccataatattggctaaaatattttaaatagtgcaactgatactgtattaaaggaaatttaagttaatctcatttttgtgcacaggcattggaacctgaaaaaattgaaattttgggtcacagaaacatagcaagaggtaagatgccttattcttttagaggtgacaattttttcatgatggtgagtgactaatttaacttcttgactgtataaatttgtatggataaaaattaattttctaagccaacaacttctagatctcaactggagataaaaaaaattggagaaatcagggaaatatggggacatcagatataaatatactcattttaatatataagcattgttcatattttgatcatcgcttgggttctcacaaatcactgactatatatcaggtttgtcatcaattcttagtgtgcttgtgttcattttcaaaataattgtcatcaagcgttttcatgacatcttaatgggtacagtaaaatatacaaacacaaccaagggaagattatagaagaagtgaaattgtcactacttccaattttgcctgattctataaaggtataaaagacaaattaagattttgaagctacaaccaaaacagacaatgtaaggcagttttcaggttctgaaatcatttcctgtgtattgcttcatttttatcttgatcattacatatgccaaaaagacaagtagtggagaagctacggtctctatttttgccaaataagggaattgaggcttggaattcagaatttgcccagtcacaaggcaagtacttgttagagccagaattgtcttttgatacctaaacgaattcatattgctttggaaattgttacacagatacatgctacagatgcagagttatacaatcctatacctacatgagattgtgtatataaacaattgcagtaggtagcattccagatctccatgatcttcatcccttgatgttatacccattaaatatgtcacattacctggcaaaagggatttagcaaatacaggtaagactcctaatcagctaaccttaaaatgagaagataatcctaaatctgcacattacaattgttcttttatggggccatttatatagtaccccaaataatgttttaaattatgactttatttttaaaaattaatatattatatatacatgataaatctcacactacataaatttcatatggaatcctgcaacaggttaattttagttataaatgttgttactttagaaataggtacaaattgatacaaattagcctagcaattttctaacccgaaactttaatacctattttttaattcatccaaaccacttaattaatctcatatatatttttggtctgttctttgggaaaccatagagtgttataccaatccttaaaacatgtttgtatatttatgtcttatacttaacttaaatatcttctctaatggaaagtattgggttttgaggggttgttgctgttcgcttgttttgagaggaggaggtagcaaaaataaattatttaaaatgcaaacaattattgtatattaaaatcttaagtgcaatatgcacttattttttattcatttttgaggtatatatgatatttaaataaatttgaactgctaaaagataggaagtagtaaagagttttctgaatactaagtactgaacacagaaacaaccagccatgaactagtagattacaaaaaactttcatgctcatggccaccttcattttaaaatccagttctgttgcatagaaacttagctctaaaacaagaacatattccaattgtttttcattttaacatcctgagttccacctttaaaaaatcttccttttataccatatttacaattaagacctctaaagcaaaatgtaaaataaaaacaaccttagatattttagtagtttctgttataagttataaatcaagacacaacttatagtctatcttcagaatggaaagtaagcacatctaggtggaaagagtaaaaagaaagcagagaccacctgatgacttaggagacattaattaatattctgttacagtcaagtactccccaaatgcaataatttaaagtcagaaacataataaaaacatatatcatatcaattctaggattgctaacctttgccaatcagtgaatttttcagaacattccaggttcctatatcttgcctataccattctcttttggattgtgtctcagaataactttccccttttaacagccagaccacaattaagaaaataataataccagatgtttattgaggacctgtattgtgccagcatttgtaagcacattacatgggttatttcttttaatctctacaacagctctattagattgctattgctttatccacactcgaggaatgaggaaacaggttatgtatataacctctaaaaggtatcagggcaaataaatgtttcatccaggatccaattcctagtctatctgattagaaaaatctttctcttaaccaatacaatacaccaacatgccagaaagttatagctcaaagactgaagtctttttgataagtattttgccaaaaagtaaaaaaatatatataaaataaaataaagaaaaacaacagtttattaaccaattatttttctaaaatcagaatgtgtaccaagtattgtgctacagcactggagatactatactgtcgccaccagcaccaccaccaccgtcaccatcaccatcatcatcatgatcatcatcatatccatcatgggccacagatatggttctatgcacttaacctctattaaacccttaaaataaccttacaagtcaggctctattattatccccgttttacacatgagaaaaccaaagttagtaatccgttgaagcagaaaatgtgactcttgaaacctaggagctttactttgtctaatgcttacttctttacttcatagttaccattctctatgtagatttctgtgatctgttttgtacatttttctttcacattattctataaatatgtaactctctatgaacattttaatggtacatataatatgtgctaataaattagaaaatattgttaaactgttctattgtatcagaaatgataaattatcaaaaacggaaaggggataacaagaaagtattccactaactacgaaagactctagaaacagtatacacaaaagtacccaccaaacagatcagactgctagtaggtgagttatttcaaaacttaaggaacagaaaactcatgcagtatttaaagtgtttcagagaagaaaagctccccaagtaattctatccgtctggcattttttccaataccaagcttaataaagttagtataacatgtcatttatgaaaatagatgcaaatgtcccaacaaaaatattagcaaattacattcagatatattttaaataattatccacaatggcacaaacatataacaaaatacaatagttaaaaccaagtactactgacacactaatagagaagtagcttaataaataagtccctgaaaagatgcaaattatatcatagcatttagtgtataatacatgtttctttttctaacagttgttttaagtcatgtggggaagcacagataacagtttggtaggaaaaacaaatagcatttcttatactcttaaatataatgccaacagcagaaatcataaagggaaacacaagcatattttataaaataaatctgttttaaatttaatgactttttttttttgagacagggtcttgctctgtcacctcccaagctggaatgcagtggtgtgatcacagctcattgcagccaactttaacaacttttaacaaacatagtaagtgcaatataaaggcaaataaaatgtgagaaaacatatttgcaatacctcacttccttaatatttttgagcaatgagactgaatctcagcactcaatataaaaagggaatctgagctaggagcggtggctcatgcctgtaatcccagcactttgggaggctgaggcaggaggatcacttatggtcaggagtacaagactagcctggccaacatggtgaaaccctgtttctaccaagaatacaaaaaattagctgggcatggtggcacatgcctataatctgagctacttgggaggctgagacaggcgaatcccttgaatccaggaggcagacatttcagtgagccgagatggctccagtgcactccagccgtagatgatggagcgagactctgtctaaaaatttctaccccatcctttcaaccaactagataatttgcttgtttattttccgtttctctccattacaatataagctctatgtgagaaaagattttcagctttttgatcactgtaattttggcactcaaaacacttcttacatctgtctgagtttaataaaatgttgttgaataagtacaactataaggtgaatggattcccagaagattctgaagtaggaagcaccaagaatctgcctccctacctaggcaaaaattgcactggcagaatttgtctgatgtaactattttgaaactctggaatctattgagggcttgaaactttcagaggatgcttttttacaaaaaaattttaaagaccatcctaagaccatatgaaatcttgaaaaagaagaaccaatctggaggactcacacttccttattttaaaacttactgcaatgctacagtaatcaaaacagtgtggtctgacacgaagagagacatagaaacaaatggaatagaatagaaagctcagaaataaagtttcacatatatggtgagaggatttttgacaagcgtgccaaagccattcgatatggattgtcaatggggaaaggacaggttcttcaacaaatgttgctggtagaactgaatatccatatataaaagaatgaagttgagcacttacctacatcgtatacaaaaatgaactcaaaatagatcaaatataaatctaagatctaaaacttcaaaactctgagaagacaaaatagggtaaaaatttcacaacattagatttggcaatgatttctttgatatgacacgaaaggcacaggcaacaaaagaaaaaataagcaaattggacttataaacattaaaaagttttgtatatccaaataaactaccacagaataaaaaggcaacccacggaatgagaaaaaaaatttgcaaaacatatctgataaggaattaatatccagaatatatagagaactttaaaactcaacaacaacaaaaacaactcgattcaaaaatgggcaaaggaattgaacagatgttttcccatagaagatatacaaatggccaataaacacatgaaaagatgctcaacatcactaatagttgggaaaatgcaagtcaaaactaaaatgagataccattttacactaattaagatgactactgaaaaaataaaaacctaaaaagcataaaataaaaagtgttgtagagtatgtgcactcttggtggggatgtagaatgctatagctgctgtgaaaaacactatgaaagttcctccaaaaattaaaaatagaattaccatagaatccagcaattacatttctgggtatataacaaaggaattgaaaacagactctgaaagggatacttgtgaagccatgttcatagcagcattattcacaatagcaaaaacttagaatatatatgtatatataatatatataaacatacacacacatataaatatacacacacatataaatatacacacacaacatatgcatacatatatacatacataccacaagggaatagtatactattttgccttaaaaaggaacgacaacacaacatacacatacatacatatataaacaaaggaattctattttgccttaaaagggaagaacattctaacgtatgctacaaaacaaatgaaccttgaagacattatgctaagtgaaataagccagtctcacaaataaggtatgattccatttacatgaggtacttagagacttagagtagtcaaaatcacagaaacagaaagtaggatggtggttgtcaggggctgggaagagggagaaatggggaattattgtttaatgagtatggatggggtttctgcattacaatataaagagaattatggagatggatggtcataatgattgcacaacattataaatgtatttaatatcactaaactgtacacctaaaaacatgattgacatagtaaatttcatgttatgtgcattttactataataattaaattgaaaattaaacccccaaacgctgtatgatatgatccattttatggttaaacatatacttaaagatacttatttagctaaacaagtctcaaagtacagacgccaatatgtcatcattataccttttcatcaatgagtgtatacttgcttatgggttacaaaatacttgaaattttaaaacaaagactagaaattaactgcctttcctcaaaccaaacaacgataattgccaaagcctttttcttaacacataaacaggagcaaagtattagattttacagtttttattttatacacctttttccattctatacctttttagaaagatatgtctattttagacttttagatttagaagtggaaatcacacaattaccagggtctcaaacatgtaaattgtttcagaactattgaggcatttaagaaaggtagaaatacagttgcctaaaggggaataaatagcagtttgcagtgacatacagattgtcattacacaaacaactctaaacagagctgtttagaaggttctcagctcctcggcagacacagttcccaggtgttgtctcttcccctctgccaagtacttctgcttttagcaggtgtgactgcatggtgggaggagggaaagaagttatgcttggaggaaagttattgctgctggagctgatgggagtaactgtcagggcactgcggcaattagtagatcagagggctacctgcagctcctccatatgataattaaaaacaccactaagtactttgtttttgttgcacatacttttcctgtcaaacctggataataaaataaataaagtttactgtctagctcccatatagtattaaaagtattttattgtaatttggcaaccacagataaaacctgaatcttccttttaaactgtttataaattagacagctatggaaacagtaggtcacttaatctattcagctcttagagtttgccactactaaagtatttattgctttttaataatgtaccatttgtaccatgattcacaagtcaatgcatcagtgcatcaagtagataacaatttattaaataacttaatgggtctatcaaaggaacacatttttaacgataaaaagatgtatataccagcagagttgttcttcatgcatgcatgcatgcatgcataaagtcagaaaataaatattaactgagtgcctactatatgtaaggtaccacgtttggagctgggtatacattaaggaacagagatattcttcctgccttcatcaagcttacagtctattggaaataagataaaaaataaatgagcaaataaatgattatataactatgatttttgaaaagtgttataatatatttaataatggtacagtgacagaataataacagggaaatatgatgtgtatgtaagtgtgtgtgtgagcatgagttacttggataagatgaccagagagagattctcccaggctgtgcagtttaagctgagggatgagttagaaacagaaaatctgcaacatatagcaagagatacatatagataaaaagtatatatatatatatatatatatgtgtgtgtgtatatatatgtgtgtatatatgtatgtgtgtatatatatgtgtgtatatatatgtgtgtatatgtgtatatatatgtgtgtgtatatatatatatatatagagagagagagagagagagagagagaaagagagagagagagagaaaataatttcaagaagatcatgaatacttaaagaccccctaccaatatgaaataaaaaaagctaagggcagaaatttgtgtgttgcattattatttagtacatatgtacatgataaaaaataacaataaatagcataataatattatgtgtaagaaatgaagttaggttactccatatctgaggggaaagcatatctcatataatagaagtaagaattatactaaataaagaatgaaaaaaataagtaaaattccagtgaaggcaaatgcagcataaaattatgaaaaataatatatattctacctacatatcatttgaaaatgtgtggcctgacagaaaaaattaactagcaaaacaataaattaaacaataaaccatcacttcctatcttcttattcattccctttagaaccccaattcaaactttcagtcccaccacgatctatggatcccatcactttttgatagtactcattttattagtgccagagatgggaaaagaactttagagactatcttagtttgagatttaatgttaatttaaagattaaaaattcagaatgtagcttcaaaaattaaaaaatacagactaacgtatgtggcggtattttagggaagcacatccttggaattctcttgagtttttggcaagcctgttgaataaatatgtaggctacttggacggattccaaatgaaacaactaaaatgatgaaaggaatggcttacaaggacagattaaaggaaaaaatatgtacgacttcagcatgtcagaaactaaaaaagaaacattatggtttacaaatatttgaaacatgtaaacttgaggaaaaacaagaactttgtgtacaaggtacacaattatgagtatattaaaaggagagatgaaactattcccctggtaataatgttaattgttttacagtgagaacatttggacaaatgacccatggatgggcaagaattaaaaccgccaagcagacatattcgacattcctagtaacctaaactatgcagacttcaaaatacgtagagggccatctgaacaagataaagtaggtcagggaacaactgcagaaatcttcctatcccccagctgtgttttaaatttagaaggaattcttccgtggatttggggcttttctctgtaagtgtgctacagtgaaaagattcctcgatttggatctataagacctagttttgagtgctgattacttattctattctcagtccatgtcctcatctgtcaacagggataataaaaacgccttaggttgttgtgggttttaaaagagctgtttctatgaacacatattatatgtacttaaaagcattgatcttaatgagatacatcaattattattaagattgtaatgtgtcaaaagctgtaggatgaagacagtcaaagagaataatgcctgagactaggcaattatatatctgcattctgcttagagtaaatcggctctcctccaggataccttgcagccctcttaactggatactgtttttcctcatataacttctgggtctgaacatgtggtaccagttcctttgctgctccaggccatgtccagaacattttccctcctctctctctaaaaacgcccagttttaatttcatgtcatctttgctcctctaccattccttagtataagtactcctgatctctgaactacaccccgtcattccttaaagatttctgtttttggtttgctgtcatcctccccaacatttcttggggcacaagattttgggattttaataaccacaaagatgatttttccaacacctggccattcggtgccaattttcttccaatcatcatgtcttctaccctccctgaatcataacttctatagccatactctcatgtttgtaattaccaaaattttaattacattggaattattacgatgcctccaaaatctttttcctccaaccatcacttcctgtcttcttattcattccctttaaaacccaattcaacctttcagcccttccaggatctatagatgctatcactttttgatagtactcattttcttagtgccagagatggaaaaaagactttagaaattatcttagttcgagatttcataaagcaacaatggtgaaatcatccagataaagcaaaaatgggtgtaatcaacagagaaatttgtaagtgggtaaatacttctggaaatgcataaccacagagaccaggttgggaaaaacacataagaaggattagaaattagagtagtgaccaagagtagggtcagtaggaatgaagggtgaggaaaggtaaaagctagaaaattctggtaagagacagaaactctgagaaatttaaaatactggtagctgagtaatttcatgtgatgcgaaaatctaataaatagcattgccagtaggtacttaaaaacagagatgggaatcattaatgttgggatcttccaggaagtttaatatcagaatgttaaaagggctacaagctcatatgtgaaagtttttaaggggacgaatgatggagaagaaacaaggttctgaagccactgaggaagtaaagcatgttatgaaggttagtaatgggctccaaaggggaaagaaagtgttatgtgctaatggaaagaaagaaagtgttaatgttgagaagcaatttgaaatagtttttgaaaaagcaagcagtatgccaacctctcctttttatctcttgagtccaagaactggaaaaaaaaaaaaaagcacaactataattacctcaagtaaagtagtacagaagaaaggagtaaaaaataagttggaatcagaacatatagattcaaattgaaactacttactccttgaattccaggtcatacaacttttttgaatctcaagtccttatctgttaaattagattaagaatatgttctctgcttatgttccctaaagtagaaatgtttcctaaagtggaaaatacttatgtttcctaaagtggaaaatgcttacgaaattttaaccactcttttattattttgggggaataaatataataatgcatgtggaggtaaatttcaacagttaaacaatttacagctataccaaggaagaaaatgacgaggatgagctcatgttagatggcatatgatatggtttggctctgggtccccacccaaatattatcccaaattgcaatccccatgtgttgagggagggacctgtaatccccaagtgtccaaggagggaggtgactgaatcatggaggtggtttcccctgtgttgttcttgaatagtgagtaagttctcaggagattagatggttttataagtgtttggaagttcctccttccctattccctctcttgctgccacgtgaagaaggtccttgcttccccttcggcttccaccatgattgtaaattcctgaggcctctccagccatgtggaactgtgagtcaattaaattaaacctccttcctttataaattacccagtctcgggtatttcttttttttttttttctttttttcagacggagtctctctctgtcaccaagctgaagtgcaatggcatgatctcggctcactgcaacttctgcctcccaggttcaagcaattctgctgcctcagcctcctgagtagctgggactacaggcacacaccaccacgcccagctattttttgtatttttagtagagaaagggtttcatcatgttggccaggatggtctcgatctcttgacctcgtgacccgcccacttcagtctcccaaagtgctgggattacaggcatgtgccactgcgcccagccttcgagtatttctttatagcagtgtgaaaatggaataatacagcataattctcattgttttgtaaaatacttaaaatgattgcagtttgaagtttttttaaaaaaataaaccatattttggttgaataattcttcacataaaccagaaaaaaaaatattctaattgatgtggtttgagattatttggtgcttttgtttggctaaaacttcttaatggggttatgtggaaataaaattaaatgaggatgagatgtaaggcaaattaaatatcttcattacactaggagaaataaaaaccttgttaacctctaaagtcactttgtactacctgatgtatctgaaaattacagagaaagcatgcttctacacatcacattgaatagcaatgaaacaatgtagaggagcaatgaaatcctagaaaattaaaataaatcaaaaaattgtgctgaaatcaaactaaatggcaagatttaaagaaaatgtatttcaaaccacttcccaagtgctcatcttcttaccagtgatgcattctaacacattaacactttctgaccaaatgaatgagcatactcttttatttctgaatgtgaaaaaagaactttacactttaccaacctaaatttgaaatttttaaattattgtcccaagagaataagtataatttaatccttctaaaataattactagtgaaataatggttagacataatgtgtgttttacaaataataaaatcatttaacaaaatatctccatgatatacaagatgtgtcactcactgagacagagcatcgcctaatagttaagaggacaagctctagatcctaattttaacatgctacttagtagctctatgatctctatatctccattttctcatttatatttcaataataatagcacctgcctcaatagttttgagaattaaagatgataattagaacagtggaacacatagtatgcagtcaatacatgttagacttgaaagatattagaaagaatgtaccttgttaacttatctaagactcttaatgctgacatgatggtggtccctaagtaatgaaaagaaagcaaaaaaaataaaaacacaaaatgatgcctgaaaaattactgtttctaggccaaaatcaaatttagtcagaaatgtcagaaccttgcacctaaaaaagggaaaaatcacttagaagcagcttttcttttaattgaaggttcataacaaacacagttaagtactttatatcctgcctgcacttgaatattatattatcaacagtgctcttgcaggagtgttgagaaatattttcaaagtaggctcattctacaacacacattataaggaatagttatgtaagaaagtgaaaaacacagcttttaaagttcctgaaactactttgacctatttttatatataagagacacactgctgtttaaaatgtgcaagtacgtttacaggcaaactgatgggggtgggtagctacattcaattcagtatatattaagtgtctgtttgggtcttcttgtttgttttgcctggtactattctaagccctagctcagtagaaagcacaaaacatgaaacaagaacttggtatataaacattaaagcactgcgaatggtaatttggtttttgtttgtctgtaaacaacattccagaaaagttagcgtttataatacagaagttaaactatagaaagataaataaacagaaaaaatagcatagttaaaattaaagttcatatagtatttggaaagaaaatgtgataaagagtgcagcagaggccgggcgcggtggctcacgcctgtaatcccagcactttgggaggccaaggcgggtggatcacgaggtcaggagattgagaccaccctggctaacacggtgaaaccccgtctctactaaaaatacagaaaaattagccgagcctgtagtcccagctattcaggaggctgaggcaggagaatggtgtgaacccgggaggcggagcttgcagtgagttgagatcgcgccactgcactgcagcctgggtagcgagactccgtctcaaaaaaaaaaaaaaaaaaagagtgaagcagagatgtgagcacagacctaaggctcaggcctgtaggtgggagactgctctacattacagagagggatctgtccatttatttcaaataaaaaatattctccaatgtttccactcaattgttttggactttcctgattgtgtcatgagcccatttcatcctggctgacctcaaataatccccagaatcagtaaaatctaaatggttcccctgacctaaaatacaagaggggatttaaaggattattttgcattcccaaaatataccactttgttaaataccaagcacaaaccttaaggaatgcatggtggcctaaccccatttagagattatcatcttcaaatcaagcatatatcatctaacaagagattaaaaccttggtcttcccatttatgaaatattatatcatattaaattattttaagagatcaatcattttgatacaaacctgttttggaaaagataaaaggcaaagctaagtcaatcttctttctccatagtaacaaccacattcaaaagtgctttagtgcttaaaaagccgtcacctaaattcttgtacttaaatcctccattctaagtcacacactataaatctgaacaattcctacacagttactatcactataataatgcatattttaaaacaaaatagcagcacattttctaaaatataaccaaataattgcaggacattttatctacattgtaaggtctacttcttttttacaaaattcagttttgtgtcttctaaaactttattaccttagaagaaaaataattttaaaataccaacattttatttgacacaacgggaaaagtcttaaataagtacattgttcagatatctagctatttcaccattaagcaggttttcaagcttaaacatttttgaccaagtctttttttaaataatgtatacatttcactgcatttgcacccaaaaaatgttgaacatcttgcagtgaggctttctctaggtcgcaaaaccagcattatcaccagttattgcattctcttatatggtgatacacttaccactccccaccccaaaccctcccaactgcatgtacccagttttttgtactgcaaagtatcactgcttttacatatactattcgagtctcctctttgtctaaaagttggcatgttttactgctctgattaagcctgacctattacttcatatgcttttcactttctggattcagtttatagaggacccagaaacttgaaagccaagagaaataagcttttctatgatacatgatctaagacctaactatgacatctatttttgtggtcagaagtttctgattctttatcctaggttctcagctatgtggtatgtggatgaagcttcaaggcaagtggcttctccacaagtgaagtggatataaattactgtatacttgatagctttaggcaggacagtgtgatcaaatcaaggtgtaaaatcctgagttgctccatgatttagatcccaatttatttccacttatgttttaaacttcaggtttggtaggcagaggtttgacattatcatcttccttttctttcctcacaaaaagataagttacaagtttcacaacgtttcaaaggtttgcaatcttttaataatgatgacaaaatatcactatcaattttacagtagatgttgtgtcctatttgccatataacaaggaaatgagggaggaggggagaggaggagaaagagacggaatgaaggagagagaaatttttatcctaggagaactctgacacagaaagaatgccactggaaaccgactatttggcacaatgtcagtgactgtataaaaaagctccttaaaagggtataatggtgaatctgtaacatagttttgagggctacatcagcagatgctggaactacaagttatcagttaaaggtcaattgcaatcaaaataaattagttcaagtccctgacatcaattgatgcagaggagtcacatatatagaaattaataactggcttaaatgggatataacaaagctttatttatcatgacatttgtctcttttggccacatgacttgttttatgtagaatcttgcaagatctaaaaaacatacactttaccataatgacaaaaagagtaaataaaagcattcatctctttccagtgcagtagatgcataggaatagttgagtgtgtatgtctgtgtaaatcaatataacagaactgctatttatgaaacttatagttcatatgaagaataagcttagaaatcgtggtataaatttcattaataattgttttactacaaacacctcatagctctctgtgtttttccttggaaggtacttagaagactccctctaaagtaatagttcaacctaagtgtgcacttgaatgtctgtgtttccaagttaaaatcctatggtagaaggattctaccttacaatgccctctttttttcttcctcagggaagcaatgaaaactaactaataacattagtttcgtaaagagtagaaagttactttatgtggatctgcagattcacatttatgacttgacttcttttatttttccttttattttattttttcctttaaaagatcttcgttgattatcctgacatctgctggtgagggcacagttgattctagtctacttttcccttcaacaacttgctcaaatcaaagatttttaggggtattttcagtgacaagtggtaatacattcagtttaagtatttatagtacttaaattcttgctgtatcacataggaaaccatgagaaatattttaataattacttcacattggcagtcatttgactctgtctataaatacatgtttgctttgattaagcaaacaacattataatcattacatggactatgataaaaataaaaaaatcattttagaagaatatttatatagtctataactatagaacatctaaggaagatgctaagcgtcttccttaaaacacagagaagaactgaataataggaatggcttagctttggttttctgctttttaaaataataatgttaattttcaacctacttagcaaataaaaagtaaatgattaactatgacagaagccattaacactcaacacatatttgcaaaatttgctattttttactcagtatccaaatgttatgatttacttctgacttgaactgagttctgaagcctgcactgtttctttggaagagatacaatgaacctattacatcctaatcttactcaaagctattgcacctgcaagtgtgtgcagtaaacaacaaatatcagaattacttttttaggcttcaagaaactctcaaaggaggcaacttttaaaaaattatacactaaatgataatatatacagttcatcccattatgcaaaatccttcaaaaatgaaaagttttagctaattaaaactttatcttgaaattaataaaattaacagctggtactactaatttaactctaaaaactgtcaagcttttacttttaatggtatcgagtgaccatgctactttattttagtcatgtatatcttattccttccctttacattgctataattttattagaagaaaaaaatcacatgtatctagagagaaaagcaaactttattaaatatttatttaaaataccctagattttgaatacatgatttatatgaacattgatgtcaatatatttgagaaaattatgacatagttttaatttagaaaagtattcagaaatacatttgcctacttttgaagatttttgcaacttcaagatcaaagaaggaaaaatagaccatctcaattttttcctgatttttaaaaattattttaagtcttttcccaaaaccatatacatttaaaacaaatacattttaattctaaggaaacatttcaggaaaaatcagaaaaacattttcagaaccagaggaaaaaattgtgtgttgtatcaccacagtggccaaaatattgcaatactgtcaaactttcacatgagaatacttcattttcacttaattcttattttaatttgatatttcagaattatttttgtatgttttaccttgactctgaagttagcatttatttttaaggtataaaatttaatggtcaggtaaattaggcaacgaagacatcaatgtgtaataataatataataagataaaagaaactccttatttctgtataaatgtaactatactaatcataaaaggttagtgttgttatctggagtgagactgttcaggtattaatttattctcatgtaaaattaactaaaaatcgccattgattaaaaaaagaaaatgcaaatgccaatgattcatagtatttaggacatgtctagacatttttagacagtgccatttgcttaaagacttcaggcacaaactgcaggcacagggacagattgcataagatgtcacgtgcttgctgcaactgtatgcatgttattgaattttttagagcaacccataccgtgaataatttaatagttaataaaatattcaatctgactgatccattggtttaattttaaaataaagacgactaataaaaggagttacatatccttatcaaatcccaggcattaatgcaagtaaattgcaacccatacgtagggaaaacaccaatttctaagagacatgagattaatgattgggggcgggaaggagtgcaaggaaaattctgtgttagcactggcttcaataagtttgccggaagtttaattgtttggagctgtcacggaagctgtactctgccttctgcagaggtgagggagaaaaaattagagaggtgcaagttttaacagaaagggctaatgcaaaatggtctatttatttttcctcaagcctttcccctgtcctcacaagctagctgggggaaaaagggagaaatctcctgaagaatatggagcatccagcttcccgagcattgtctaagagaaccaggatggagagtccaggcaacatctccatggttggcttgtctggcggagtaagctgtgccctcggcgcgggtatcttcaggagacagagctcctggctgcagcgagccgggacttgccgcgccccggggctccctcaatcagacccagccaggcaagcgcggccacataggcaagcgcggccacataggctagacgcactatcttctcctctaccccgcgccgccctccacctcggagcggggacgtacggtggtggcggtgacacaatgcgagtgagtgggtgagtgtgttttcgtgtttggggtggaaacgtaggcggggaagagaaggaggagaggggagtgcctgcagtccttcccccttcccttcctgctaagagatcaaagtgcagaggaaatccagacgggaaatgagagaaaggaaaaacagcagccgtggaagcactctcttttttatatcgctggagactcggccgagcaactactggaaccattaccatttcttaacctttagtggagtggctgcctttgcctattaactggaagggcactttgtaaacgcaggcgaggcacacacctacacacacgcctacacgctgggggaaaataaccacattctgggggacggagggaggcccaggcaaggcgcggccatggatctctactgccagagctgcgagggcatctggccagcaacacccggcttcttgggcgaacagtcgcccaagagtccacaattttcttgtgactcaaatagatggataggtgcatggatggatggtgcagaatattcatactctgtctaatctcaagtggactggagtcaacgcatttttaaatccatctaccttttttagaggcacagcatttaaaaccctgtagttcactcagctttccacttgaagctgcctgcagaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgcaggggacctggaagtcgcctaaactactccagcaggacactcgtcgaagtcctgcgttttcttttaaatgcttttttctttttaatttaatttgatttttatttttctgtttttattttttcgtgcaattcacagaaggcatcaccctacaagctctcacaacttttccgctcctgtgcggggacgcgaggggtggcttgccccgcactattccccattaccaagagttaacactggtactcggagggggtgcgcagctaagctccaggcccctggggtcagactaggagaggcgggttcctggggtttgctgtaatcgatgctgctcctctgggatggggaggcaggagaaagctgaagtgacctgtgagactcctctccacctcacccgcggccaaaacgcccagcgccgggtctgggtttgcgaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgactaaagagaggagcctttcctccccttttgcctgcgctccggcgcgcggaggtgggtgagctccggggagccgccggcgggctcagccctccgctgcgggtgggtcccggcagaggcgcggcgggcggggcgcgggctcccgcggccgccccgggtctgctgcgcgggcaggcagacccaccggcagacaggcggaccgggcgctcggctgtcgctgttctccgcgcggcggctgcggggcttct

SEQ ID NO: 224 - DNA, 58477 bp, Homo sapiens
  source 1..58477: mol_type = genomic DNA
ttatcttttaaaatgtagtctgtattattttcaccaaccaaaacacacataatatattttattataaaacattagcaatgttacttttgagatatgcaatctgaaaggtcacacttgtatttattaccaggaggaaataccagaggagtcacattagaaatcaaccagacagactcgtacgtggttatcgctacttacacagcattaaatgcgggttgaagcagcacccgctccgtgtttcagacacggacttggggtgggcaaggggccctgtaagagggcttcctcctctcagtactggggctctgcgtctcacctgctcccatctccaggcccacggctgacacggtatgcacagccagggtttccagactgctctcctgctctcacagaactctgtctgctctctggactctgcccttgaaactgagacctggacatgggggagacagtcgtttccttcttggctggaaactaagtcaacaaatgaaacaaacctagtctaaattccaggataatagtaaattacctggtttataaaaatacatgtccaaaatagttacttcctgggttgtgtacaatataaattacaaaaataaaatagaaaagatgaaacagttgagcacatttttcagttctttaaccaacatcagcatttatccatagagatcagtttgaaaccatttgcgtggcaccaagaccctggcaaatctaggctcaggagagagaaccctgaagctggggtgaggtatttctgtggagccctgtggcctgtcctaggcacgctcgcctctacctggtggaagatggcctttccaggaaaccctccacaccgtcacgggctccatctgtggcaagtggctcgctgaatgcacagaggagcgagtgagcagaagggcgtctgcgggtgcctcgtcccccgtccacgtctcccggggagggagcatcacacagtgcagggcagctcgcgcattttcaacctctcccttttgtttttccttttaaagatagatttagtgaagtcttttaaaagaaagtgtattacagagaaggccattttaagatgtttagatagatagccataaaataggtgtttccgcctcaatccaagttattattaccattttgtacttgaaagtgtccaaatgacacaatataaaagaactatttcttatttcaatattaattttgctaatcaaaggttccagtttccagtgatatgaccaaccaataagatataactggtgcagagagagccatatattttacataatatttataataaactttcttatcacagttcctcctcagaacacactctacagaatgtcgactgaaaagcttccaaaataattgaacacaagatatgaatcagcaacagaataagctcaagggaagagacatgggcacaggcaggcaaaacgtgatcaccacagctccgttcctgcagtgacacttaacatactcagcatcttcatgaattctgaataatttactgatcgtaaagtctaaaagtatcaatttcaggtgagcagttttaaatcagaaaatagtcaatagttaatcatgactcttcagggtatttccttcacgtcctctgaagagtttcccagaacattcttgtgaaaaggaatgcctcccaacaatggagagcaacaatagcaacaggcatctgaatcagcctggcctctgaaaacagaccaaagaggagtttatctgctttcttccagtgaagaaagaaaatcaagaacgtggtattggccgagggaaagtgaatgagggaaggtaaataaaggacccaggccagtctgtggcaaaggaagcacttaggaaatgactgcagtgatctctagtgagcattttgtaaaattccactccaacgttaggccatggatgcaggaacctatctgccatcatatttaattaagatggagtgttacgcacctaataaagaaggtgaagttctaggtagcattttaaattcataagaagtctagaagaccaagaagaaaagagataaggtagctaggatttcaagcagcactaagcaaaacttaaaattgtatcgtgcagtaaagctgaatgtacaatcatcccagacaagacagtttaaagaaaacaagatgtccacataagtgtcttggttttagccgtgataattctcagccccaaacatcacaaatctaagaaaagctatatatttttatttattaaatagatttaattatatgtcttctgaaatacaaaagatagaataaatcatagcataaaagggaataagatatgataacatcatgatggccaattaatacacataaatcgactttttctggacagacaccaaattacttaagaggattaagagataacttcagaagcagcactacctggaagattatttggcatttaaatactgatttccaaagtgctagatgggcaagtccaagcaagcatttgtggtcacatgcacatacatctcaacagttacagatgatgagaaactgtcactagtacaatttgaaacaaattcacctactctaactgctcacctgaaatgatcttgaacaaaatctctagaagtgtggcttgcaatttttttcttcagacatattctgcctcattttatcatctaagcaggcaatcctatcaggtctgagtagggcaaggcattgtgtttcttacatgcagaacatggagtttttctatttggttccatcaactcccaagcatttcaggcccacggaggtgagagttccttcaatgctgacaggtttgctatttctaacctatcatcgacagccttcaaggggtcccgtcgaggcatcaagactgctgtctgtgtctgaggccagcgtctgctcagtggacatggatgaaatgtcattgatcgatgaagactgagaaggagtggcgttgctacttactgctgcatctgtgctaagaaaaccaaatataataaaatctgaggcacgacattgctgcaaatccaggcagcgagactgcaggccatttctcggctctgtccttttgcagtttcccaatcctaactatgagtatagacaagaagtcagtcagctggactttctgaacttttccttgagtctttctttgggccaagagtcccatattcctatgtctttccttgcaagattcttctttttttctcagtagctaaacatatatgtggccatgtataatcatgttagctacttaaaaaatacctgctgctttcaagcagacatcaaaaggacacagctatatttatctgaaaatgcagtatcacaaaagcttaagcctgactaggattccagtgtcaccagacacttgaattgtaacaatttataacataaacactaaatctacaggaaaaaaagcatcaactttcaaagaaatcttttgcaataaataaagactatataccagaaaaaggaaaaaaattagtggccttgtatattttatggttttataactccagaaaactgacattttaatcttttaaagcaaatgaaactatcctacttcctactatccatattttagtctggtttgaataaaaacacaacatgcactctctgagatcgacgtctgcagtcatacgtgtgtgctcagttaacaagcacctaagttcttgctgaagttatataatctctagatgcttgacacatacgtcatgttgaacataaaattcaagaataaaaagtaagctgtgctctctgcacatccgcacacatgtgtgtgcatgcttcccagtgggagtgggagagagacaatgatataacgtgagcgtttcatttagtaaacaggaagaatccttcagacgtaagtgaacacgactcatatcagagtctcatgatcatacaactacctggtcattagaggcttccaccactatgaagatcagtagatcaagcagaaaaatgggaaaatgatatcaacaattttctcaaaaagaataccatactccattttacttagattggcattttgggtgggaccagtacaaagggttatcaacattgaaaaggctttaaattcaatttcttcatctgtaaatggaggtgacagcagttattgcaaagatgaaagagaaatgcttataacaaagttcagtgcctggcacatcagtaaaatgtcatccaccaccaccaccactatgacaagccaaaaaggctggctattcatacagcggtttttaaatctgatgctagccaggctggcatttcacatgttgctgccatttataaaagttgaatcgggaaagacgccaggtgcggtggctcacgcctgtaaccccaccactttgggaggctgaggcgggtggatcacgaggtcaggagatcgagaccagcttggccaatatgctgaaaccccgtctctactaaaaatacaaaaattagccaggcatggtggtgcgtgcctgtaatcccaccactttgggaggctgaggcgggcagatcacaaggtcaggagatcgagaccagcttggccaatatggtgaaaccccgtctctactaaaaatacaaaaattagcagggcatggtggcgcgtgcctgtagtcccagctactcgggaggctgaggcaggagaattgcttgaacccaggaggcggaggttgcagtgagcagagatcgcgccgctgctctccagcctgggcgacagaacgaaactctgtctcaaaaaaaaaaagttgaatagggaaagaaaaatatcatacaatcaattaaagcaatcactaacctgaaggctgatcttttacaacaccattcttgcttctttcttcccaatccatgacttctttgtaaattagctctttaataaaaatacaagttaaaatgcttaatcagtttctaaacagtttcactgtatctctaaactctgcttccaaatcaactggaacaaaggcattgcgatttgttatttttaattgtaagacagagtcaattcagtaatatagtctacctggaccaaaatattcatattttgatacattatatcttttcttttcttcttcttcttttttttttttttttttttgagacagtctcatgctgtcatccaggctggagtacagtggcatggtcttgactcactgaaacctccacctcctggattcaagtgattctcatgcctcagccatccaaattgctgggattacaggtgttcaccaccatgcctggctaacttttgtagtttttgtagagacagggtttcgctatgttggctaggcttgtcttgaattcctggcctcaagccatctgccccacttggcctcccaaagtcctgggattacaggtgtgagccactgcgcctggactacattacatctttttcaatgcaactagtaaggcagcaaaacatgtagggtggttctggatccataagggggctttatgaagtggagtggctcccacagaacactgtaggggattggatattctcacacccatttgaatatgtttctctatgtggttacttggggttctccaaaggtaaccagcacccacatgtgggctaggagccccccacactggccagaaatgaatccacaggcctaagtcttttcttaatttcaacttcggttttcctcaactttcatctgtaagaaaaactaattacctacgaagtaagtgatgagggattcctaaaatgtcagtattcataaaccaacattagcacgttgcaagcattcgctgaggccagtgagcattgactgaggccagtgagcacgctgtgtgcatgcactgctgagcacgggcacacacaggtaaccggcactcccacaccccaggatggccctggggcatgaccctcatcagtgttgactgactctgactgtggttctcagttactactgatcctgcttcttaatgaaaaattgttagttcaacctcttcattacaggtatagtttgttgtgggttgtttggttaatcttatagtggtaataatacctatttgcatattttcaatctgcaatttcccccaaactagattttaaaacatatgtacaactacatggcttaaaaacatatcaatcaatataagtatgatacaattactaagctcagtttataaatcaatatgtgaaaagccatgaaaaaaatattatttttccctcttgaagcaaatgataagaaattcataaatgttcctctctaactctgttctcttcaagttcattttctactggaaactggggagaaagaggctaagtgggtcgcagggtttcttgccccttcctgaagggaaatgtcacaaaatgaaaagcctctgctctacaggattggaagaaatgtcaaaaggaaggatcaaaataagctccatctttacctttccattcttcaattgcatgttctctttcttccaactgggcatcataaatttgaggtggtggctaaaaattaaatcatatgtaaagtcaacagtaatgcctcaaaaaaaaatgaggcactaaaaaaggtaaaattgcttggaagacttctagtctatttatgatatggatttagtttaattcaacacgtggtttaataaagatttgtcatgtgatattatatcaactttagaatcaaaataattatgaaaaagttaaccaaagaagagttattatgttcctcttaataatcacctgacctcaaaacgcagacatctgcccagatgtcattagaaactcatcatcacaggctgtttcccagagacccattatggacaaggcactgtgctggcagctatggaaggtactgttgtttcttagaacaaattttacattttcttcatgggagaactcccaaatccaatgtccaactcataaatggactgttataaaagtctgcttataaattggattctttttatataaaacaatgtttaaactgatggcaaaaccacaggccatgacataaacatgtatttcactcatggcatgaaggaagcctgccactacgcagtgatttccctcacagctaaagctcactcacaccagtgctgacacagaaacacgcacgtgagcaccaaactcagagtggagctcctccagcgggggaaccaggagctacaatgcctttagggaaggataaacagacgtgtgatttttcagcaagttgctcagcctctctggttaagtggcctaaacaagaggatgtaaccaaagccaatggcacagaatagatgcttaataaactatgagctcacagcagcatttgcaaaatggagactggtagcaccaaagcggaagttcattcccgaggtactctgagctggggctccagcagcaaaagagcaagcgacccaggtctcagacaacacttggcctttctgtaactgggagcccccaaatggagaacttgctacccatatgtagccactctggacggacagacaagatccaaggaaatataagcctggcctctctatataaatcttttcaaaacagatactcacggcttctgcttcggcggggtcataccaaacagtgatgtatgggtgacgcagagcttcgtctacagagatccgcttgtcaggatcaatcactaacatttttgataacagatctctggcttgacttgctagggtgacaacaaatattaaattaatgctgttaatatgaaacaaacagaatcatacaataaagaactaaatatgacaacacagatagaacaaagatatattaattttgagaaatgtttgataggttcaagatgaatataacccaaaattttttttttttttttcggagacggagtctcgctctgtcgcccaatgcagtggcgcaatcttggctcactgcaagttccacctcccgggttcacgccattctcctacctcagcctcccaagcagctgggactacaggcgtctgccaccatgcccggataattttttgtatttttttagtagagacagggtttcactgtgttaggcaggatggtctcgatctcttgacctcgtgatccgcctgcctcagcctcccaaagtgctgggattacaggcgtgagccgccgcacccagccataacccaaacatttttaagaaaaagtcaaatgtccactttcatgacaaaccaggtttccaaatgtagttttacgcctctggatctgcaaggggaagagaaacctgggctcccagggtggtggggaagagcaccaggcagcctcagaccaatgtctgggcagggcccaaggctgggaaaccacagcaaggaaggtggcaattgccgagctgcgggtggcactgcccagagtgtgggcatgaggcacgggggagtatttttctctaagtcacatcgaaatgaaattagaacagacttttcaaaccacacaacaatctcacattcccacaggataaaacactcacagatgcttctggctggcctagctgtatacagtgctggcaacttacacttttttttttaatctacagattggtatttaggaaaaagaaaaacaagttcaataacttagttaaatataaggctcacctaggttttgtcaattaaagttcacaacctgaataagcaaagactggggcttttctgattaaggcacagtttaccttcatgcggacagaatcaaatcttttctttttccttaaacaatcacactgtagtaaagggtgcaggagaaggtggggaggaaggacctttttcatcgaacaactgtcacatcgcttctgactctagaatctgcattaagtgttcttcttacctgaaaactttttgaattccagttgctgtaactgtaacataagattctttcagactgatttgattatttttattttggccaaaggcttcaattaagccgtcttatagaggataaagcttctagacctttaagctttctctcctcagtgccttcgtacctcagacttcaggcctaaaatgactttctctcccaaaacacaggtttttagaatacaaacatgaaagagtgaaagcaccacctgaattacaaaacacaagtataagaaaaaaaggatatcttactttttattttgtctcgctcagattctgatgggaatatccaatctggaaagagttcttcaaatttgattccaggatactttggtctgttttcgacataattcctcacagttggctgaagtttcttcatgaactctgctgatggtgttcccagctgctcaataactttattccactgatcaatatctaaggagtttcttgaggaaaatacaactgaagtaccttgtattcacagtacatgcggcagcatcacttgaataatatttaaacctatcgactaggccaccccactggatcagcagcggaattttgaaataatattcaaataaggtttgggtttccaagttacactattttttaaaactctcacactctgcatcttcataaactatgatcacagtttattaaatcaacacaatgaagtctacacaccttcccactctagttcaaaataaagtttatcttataactaagaatacctatagcaaaaatgattaaacacgaaattagataaacattacataagcaaattgaaatcagttttcatactaatgctaccttagattcattcacagctctctaaagaacagaggatctcaagggacctgtggagagacctatctgacctcctcagtttacagctgggaaccaagcaactgggcttagactgagcccagcgacagctttcaaatgatgctctattttacttggaactgactcttcccaaccatcactgcgatccctaggtaatgcattttatttcctttcaaagtgcgtgacctgggtttcagactcaactctgcattaaacactcagtgtgtcaggaaagtcaggcttccttggggtctgtttccttatttgttcaatgcagacattaccagctttgcctattccacagggtgcttgttaggcttgggataattaggattacatgtgggaaagtgacactgaaactgtactcgctatacaagagaatgcaagtgagaaaaaaatagcatcaacagcagcttaaaaaagtgctcactgaggcatgtcttagaaaaatgaacttacatcaccatgaaataacctagggaactggtacatgaactcagttcttccaaaatgttatacttccaaaagacccgctcaggaaatgtgtttctggcattcaattcactagcaaattctccttcctactcctggttcatacatattgtcaaatcagaattatgcccacattttatttacctatttagccaaaatgtgaaaactgtctcacaccttttccttctgccatatatacatatataaataaagacagagtctcgctctgtcgcccaggctggagtgcagtggcatgatctcggctgactgcaacctccacctcccgggctcaagtaattctcgtgcctcagcctcccaagtagctgggactacaggcacctgccataacggtcggctaatttttgttatttttagtagagatggggtttcgccatgttggccaggctggtctggaattcctggcctcaagtgatctgcctgcctcggcctcccaaagtgctgggattataggtgtgagccactgcgcccagcccaccttatacttttgatacctcttctgcctgctcactcccacagacttcccaggatgcacccacccagcatctgtgtgccatttgccacacagcaaccatctgggctcccggctacactaagcctgctcagctctagaccctaacccccctgactcaaggacaagctccctcaactcttccttctccaacatcatcgacattttgcactctaccaatacattccaccacgttggtaaatgatggtgttttctcctatgttaacacagtagctgctttcctttggccctacctatcgctttatttcttattcctatttgcagcaaaaacttccataaagagctgtcggtcgggctcagtggctcacacctgtaatcccggcactttgggaggccgaggcaggtggatcacaaggtcaggtgttcaagaccagcctggccaagacggtgaaaccctggccctactaaaaatacaaaaattagccaggcgtggtggcgggcgcctgtaatcccagctactcgggaggctgaggcagaagaatcgcttgaacccaggaggtagaggttgcagtgagctgagatcgcatcgctgccctccagcctgggcaatggagtgagactctgtctcaaaggaaaaaaaaaaaaaaaaaaggaaagaaaaaagagctgtctacacttgtgtctctaattcccagcctctcattttctctcaaacatactcccatcaggctttcttccctccactccataaatgctgtgcccatcatggctgccagcagccatcacaaggcccaggggccaatcccccgtcctcatctcctcatgtgaatgagcctccctcagtcaccacactctaggaggaggggtcacgtgagtgccttctccatttccttccctattccctttgtccctccacctcaagggggctaagtcccgggtcctggtctcttcctcccctgcaagtgctcgctaccagtcctaggcttcaaggctaccgacagacggatgacacccactttgatctctctatcccagaccttgcccctaaattccactgtctaacagacatctccaaaccctagcaaggctccttgaagggtccagcttcaaagcagagtacaagcccatctccccggccacacccctacccgcctgctgggggcctccacctctcctctggatgatggcagcctctgctctgttctcctgctctgccctgcccttgacgatccaccctcaattcagcagctgggaggagcctctttgcatctcagtcagactaggcacccagaaatgggcaggtgagagaaatatctgctgggttaatgataaaggactagaaattaaaccagttgtgagaggagacccacagattccccgagaggactccaccccagcatcctacaggtgggagggatgggggacagatgagagggacgggggaaggggaacaataattccgacaagcccagtggaccctgttgtctaactctcgtgaagctgcaggcagaccacaggtctattttacagaaggggaaaccaaggctcagagaggccctaaatttctcaaggatgcatggctgccaaggggaggagtctgagctggggcccgaggtggccgggctaaagctttctctttctcatagaccaccgcagggacaggagttccttttctaccctgggtcgcaaattaaagcaaatctctgagaccctcagtctgatttctgcaacttttttctatctcccaaatttcaatctaatatttgaaagagttggcaaaattttctttagaaaatgatgttaaactctgtgtggcttttgggaataacattaggtaaccttatatataacactattaattactgacattaatgttcatatgtatagcaggaattttaattttacttactaaaatgcaccaaaaagtactcacatttttcatttttgtactttttgaagaaaacattttgtaataaaacaaggaatggcacaaaatgagtaagaattgagacaaactgaacattaagtagatatttctaaattattagtcttttaatttttcaacttttccctttttaattaagtttacttgcaaaataaagacgtccttatttataggttgcaacaagtgaatctgagatgaggctatggaaactgctagaaaatttagtagaacaaataaaataacttgacatattatataatctatgatatagaaaatgtaaagaaaggtaaataaaatgagagaaataaaaatattttcactttaagtttgcactgtgaagaatttataaggagaccactttgataaaattattaaaatctgaaattattttcctaagatacatacaaaacactgactatggagcttgatttccttaaaagcaaccatcaatctgcccaaggatggagaccaatttaaactttcataacgaaaacaaagtcaaagactaatgaaaaactaagtggttaaaacacaaatgaaaaagggaagatgtgaagaaccatgttagggtaaaaaatactgaggatggaagaatggcaaatgaggaaagaaggctattgtaacaattagagtagttattctcctttctgctgtatctctaacatgacttgctgactacagtatgagtttatctctttcattttacatttattttgacttccccagtgtgtcacaaaataacccactagacagatttttaaaaaaaattctacaaaatgtcagcacagtaacaaacaagaaagtttaacatattgttcctcacaaaattttcattttaatctctttcacttaggtcctttgtaatgtgcttcagttcttactttgggggaaaatatttcaatgcataccagtaactaacaaaatagtacttaattaaagcacacaagcacactagcctattaaatttagatagcatctttcctagttaaattaacggaataaactaaataatacagtattttcatttaaatatcagaatatacttatcaaagagtaaataatttcttctatgtgtccagctatttttggcaaaattaagagctaatataatcggtttaactgaactctaagtctcaaagtcatcacaggtagtcaagttaaaaataaagaatgaaattgaaccacttggcttgtgacactaattaacaaatacagtaaagccccccttagaacacagtctggagtggattttacgactttgtcctcgtgagcgctcgtgtaagcaggtggtcatgctgcctgaggcattaagaaagcatggcggggccaaggtcgcggggaaggatacggtcagtgccttggaatatcacacaacctttcaccagctctcccatgatgcaacccactgaccagatatcaactgaaaataaaatgaaatgataaaattatgaagtgccatgaacaaaacaaaagtgaggaaaaggaattctaacagtgcactaaacacacaaatatggaaaaataaattgctagctaagggtgacattttacacaatatgaatgattgctgacctctattttagccttcggtttgtagcaatctggggttttagtgccaaagagtccaatactttatagcttaaaacaaacaaacaaacaaacaaaaaaccagaaacaagaagtgcctgtgaacacaaagcttttcagggccacacgcccaccccagcctccatggccaagtaccgggtcccctgtgaaggatacagtctcttcccgggaacaggactttatggaggaccatttctgccatgatgcacccgacagaccagatgtccactaccaaacaccaggggattaaaaaccagctagagtcccccatcttttttcttcaaaccccctcccaggacaaacccggtacacgtcactagcttgccggcgggagcctctgtgcgttgttgataccacacctcctgagcgatcattttctagactgccccgtcagaaaggcagcagcactcactggcggcacaggctggctggcttgcaggactgcaggtgaggccctgctagaggggcccagacttccacggtgcccaccctcatctgtggggcctcagacagacagcagaggcctctaagtgccctgctggcgggccgaggggagaagtgaacaggggatcaagttttctctcccctccacaggaagcacatgaagctgtgcccctcagggtgggaacacaagctacaacgcagcaagatgaacctgtagcaaaactcatttcagatgacccgggcaaactttcagtctttttaaaaataagtaagcgtgatttcgttattttcaacaaatttgctaaaagccaagtttcaaagagctctgatattgctagaataagctaagttttgatgtaaaaagacaccaattttacatgaaaacatgtgttattctatttacatcaaattcaaaaaaacaatatgcagaccaacaaataaagctgatccatggtactggagatcaggagattggccagcctcgtgggctgcgaggaggggccatggggaggccagagctgctgctgctgtgggtgtgctcacctcagctgagctgcacactcaggatttgcacacttggctatagacagcttaactctgattaaaaagttcaaaaataacaattttaaaagtgaatttttaaaagagaatgattttaaccaatggaaaaacacaattaattatttcttatctctggatcatgctatattctgggtgtaacagtccccacagtatatatcatatggttcaaaggaaagagaaaaaactcgagaccaccgctagagcaatttctaaacatcccagcctcttccagccccggctatactcaccgttctctttgtagcccatacccaggatgacttcgggcgcccggtagtaccgtgtcaccacgtaaggggtcatcatgaagttagtgcacgctgtccgggccaggccaaagtcaaggatcttcagggtgcagtctgatttcacaacaatgttgctaggcttcaaatcctaggaaagaaatggcttaaattagtaaaatgaatgaagcatgctaaataaactacttcacatccgtgagggtcgtgaagccagtgtgagagtgtagggagtgaactgaactctgagatttgggaacaactttggaaaatcttactctcaaattgaaactaaaacaaatcagcctaaagccgtcagatggtgccccttacccccagtggaaaccttcatggcccccatttgccctttctgtggtctcgcaggccctcaggctgtcctatctaccctccatccatgcatctacacgtccagcacacatgcccccctcccgctctccacgcctggacttgagttccccaatactctgactctctcttgctaaggtcctcatgctgtcagtccagcacacacggccccctcctgctctccacgcctggacttgagttccccaatactctgactctctcttgctaaggtcctcatgctgtctgtcagtccagggcagtgctgtcccacagacaatgtcatataatgcgaacgatgtgtataatttacattttctactagccatgctcaacagcatgcagaaataggtgaaattaattttaatcatacagtatatttttttaacccaatatatccataatattatcatttcaaaatgtaatcaacataagaaaaatactgagatattttacattctctttttagtactgagcctttgaagtccagtatgtattttacaactgcagcacggccacatcctgagtgctccacagcctcctgtggttagtggctgccatactggacagcacaggtctagaatcgtctgatcctggaatcttcccatggctctttctctccttggaagagcaattccatgatcatccacctccaatcttctcaccttcgccacaaagacacgccagcactggtgctgctgtctccatctgtacgtggcacaaaaactcacctgctcatgttctggttgccacctctcttccctccccagtgctgactctgtgtgagctctcagcactcagaagcacgcctggcgcgagcagacacttgggaagtgtctgcagaatgaagacatgcatcatattccacctgacttgcaaagccttaacacaacttctgcaaccttttccctcataactaagggattttcttcctgctgatcctccaccctagccccttcctcaggccttaggaatttgacttttgcctggggacttcggcctgcaaactcacttgagaaactgtgacttgtaaacaacccacacccattcttttcacaagagtagtgcacctgcaatgtcaaactgccaagccactgacatggcgtaaggcatgaggatactttacccaggaagttgcaggttcagtagcactgcctagcacctgcctgtaagacaccccaactgatgggccacaaggggggttgcaggcggcatgcctcagtgaaggctgtggggctgtcatcagggcaagcaggaagccatttcgacattgacaacaggtacaattacactgccatgctgctaagtgacctgtttctaggcttcctagattctgtaagatttaaatgataaacatataatgtttaaaaatgcagtcacaatctctacctggccccaaaaagaggcccccagcccctccattccaccttagagtactgtgcagacacccccggttcccagaaaggcctgagaggaagaaaccgggctgcctccctgcatgaaggaaagccagggagaagcagcccacattcaaccagggacgctccgctgtgaggaccaagtcagggagctaagaccaaatgaacgaattcgcttcttgtttccttttttaaaatcaaagagtatgacaagaacaggcattttagaacataaattactaacagataaaataatgctcaatctcacaaaaatcttctttaaaaacccaaaatgaatgcccatttttagtctatcacttggcagcgatggaaagcaagcagactcggtgctggcgggagaagcagaaacaggcgcttcctcaggccacagagggtgtgcagtgggcactttctctccaggaggctgatttctgaggtgtgaaatgcacacacttccccagccagcaggccctgaagcccagcccacccagaactaacagcacggccgcaggagcaaggaagacaaggacagcctggttctaccaaggacagacgcagcagtggaaccatctccacgggctgcctgccagctctgtgaaccccagtgcgccagaaacacgctcatctgaagacactgccatctgtcaaaaaactgtcatcacatactaatttaacaggaaaagcacactttactgccgtctgctggaagactgtggtgataaagtcccaagcttgtgtgggtgctctgtgtggccaatggggaggtggctaaggaggtgctctccccgcaccctgggaccctctctagtcacccccgaaatacaacctgaggcagcttcccaacacctcacttcaatttcaagacagcagaggaaagacagttctgccccttcaagtcttgaaaatcactcagaacaaagaagacaaatgccaagtacagatccaagtgacgcctggatcggggcttggctcccaaaatgcctggaacccaacgctaccctgtgggcagcagtgagggtacccacagcacccgcagcatgagtggggcaggtgctgacctcccccactgcccgctcaactctgggatccagacccactgcttgagaggtatcccaggaaggagcacatcatgacaggtgtccactgtctggccttgccggtccttccccacaggtacctgtggccacccaccgggtaagaacagccaggcactcttgaggatgaatggacacagctctaagtagacactgaaacccgaagaccccaaacactctcagggctcctccacttgcagggttcgtggggtcaggggtcaggggtcagggcataagtgaagtctgggccaggtctcttgcggccatgttatgggagggtgggaacgttagcaaaggcttagagcaaggctgtgagagaacattgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgcggccaggactgccagtgccgtaagcctgtggccgtctggggtcattctccagaatccatgcagcttcttcaagggctggactaacgagttagactgggatgcaagataccactgtctctgctcccctgaggcttccatggtggccctagtctcctccacccaccccgggccctgcagggtgtgatcttgtttttgatttactatcttgggggcagtttcaggtttccatttggccttcccactgtgacgactcttactcacaggccaaggaactcgtgtgggcgttactccacctgccaagcgcctccgctccggctacacactgaggactggggagacggccactgggtggcctgggaccctgtggcccactgagagccaccagacacagacggctcaggaatgaaggcctgggacacaggccaggcaagccacagaggcctgccaatgtgagagctgagggtatgaataacaggaaagggtagggaaagagccagcagagagaccacagtgacagggactacagggtgtcccactaacctctgtcttccagatttcccctgaggaagagagaaccatgggcgccacaggaaagccattcccaacttatgtggagaagtagagctgagggggccagggtggactgtggggtccacggaaatgcactccttggtctcccgccacaggagtgagagtgacagatggcccagtgtggtgtctgcacctaccctctgtccctgccagggcacacctcccacagagccgtcagccaggggccgaccgggcagggatgctgaggcaggcccgttcctgtgtgacaccggaggccctcagagctgcaccgcagtctggaccaggcctctgaggggccaggactgcactacgttcagctagcatttgctgcctcctctggctgctcccccttccttctcgcacaggcctcctcccggccagtccctcgcctgtctaacccaccgtggcatgcggaagccgcccacgaaaagccccacgctacagggacaggaagctgcagggccgcccaaatgccctagctgagcgaaggaaatgccaacctctataaatggccacgacacccaggaaaggctcagcaagtgaaatgcaggtgctatggaggcagaagaggcaagggtagcacttggagaagttttcattttattgaaagtccaagtacgtagtagatgtcccagatccccatctccatcccagaagtgaggctccactccttcctcactcctgctggcccttcacgcagagaaactgatgcccagcttccaggtgcagggccacaggcgccgcatgcacagtcctgtgggtaccaacagggaaggcacggtgaggcctgcctgcaacagggctgcctggtgagtttgcgctctgccacatgagaagcacagccctgtaccccagcagccaggcttacatccctccaccaagggactgaaggggccttttccagagaaattaaatggtgcccagagaaaaaacctacagaaggtgacacctgtggctgcctgtggtccaagagacacccattctttaacaatttacccattcactcagtacttccagtcagcctttaatgcttcaatctcttttttttttttttttttttgagacgaagtctcgatcttgttgctcaggctggagtgcaatggcactatctcagctcactgcaacctccgcttcctgggttcaagaaattctcctgcctcagtctcctgactagctgggattataggcacctgccaccacgcccagctaatttttatatttttagtagagacagagtttcaccatgttgaccaggctggtgtcgaactcttgacctcaggtgatctgcccgcctcagtctcccaaagtgctgggattactggcatgagccaccgtgcttggcctaatgtttcaatcttaaacatgatccaaccagacatttggggaaagccttgcgtgtgacagggagggacctaacacactaaaaagggaactctcagtagagaaagacaatgcagggagtgataaaacccttcaacaaaagcttatcctcagagatgatagtatatacatgcaacaagaacagaatgctgtaaaaaggaacttttaagagcaaatgagtgtcaattaactcgtgcttcagagaaaaagaataaagaatggagttaagaggacattctgaaagaaatgatataaatttctcagacctctataatatgtgcttccagactgaaggccaagtgcccagcaaaactaaagaaaaaatgcccacatcaaggcatacatcaaaacatctcagaatacaaggaataaataactgagtttaaaagtttccagagataaaaccaaaccaaaacccaaaaccacagcacttaaaaaaggttagtcatcagccaggcacagtggctcatgcctgtaatccagcactttgggaggccgaggcgggcggatcacgaggtcaggagatcgagaccatcctgggtaacaaggtgaaaccctgtctctactaaaaatacaaaaaattagctgggcgtggtggcggacgcctgcagtcctagccactagggaggctgaggcaggagaatggcgtgaacccgagaggcagagtttgcactgagccaagaccatgccactgcactccagcctgggcgacagagcgagactccatctaaaaaaacatcagatggcactaagaaactccggagccatgctagatgccttgctaccacaggcactgcctccgccattctgagcgcaactgatctgtaactaagaattctacacacatctacacacaaccacactactcatcatgtgagagggcagaataaagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcaaaggggaacagggctgaggcttgggagaggttcctgagaagatgaaactgatgaaatacccaagacatctacatgtgctgagagaaaattcagatgcctgatggaagagttagggttgaattaccaccaagaacacagaaactaccccccaaaacaaacaaaaacctcacacaaatagagtataagtgtttgttaactccagggaacaaaaggtgaaaggggaaggtctgctgtgcaaagcatttacacgctcacgatgacgcaacgagccaaacaccatcacatccaccagcctgggaggagggcgaggaaggccgagggtgagggctgggttggtaagaagctaaatcagcatcttatgccccaaactgagaaaggatcaatgaagaaagagctaagcatattatttcaatatggaaatagagaccaaaataatcagctaaatgaactgaaggagtttgcttctagggagagagaaataaagggagaggtggaggtatctgtttttcataaatatttatagaaatatttgatccttgatttaaaaaaacaaaccaagctacctgtttaggaagttgctacgcagttatatgcaaggtgatcctgtctttgaaggatgtaagttcaaaaggacataagtacagatatgctggtgttaacatcagtcaacagagaggtgccatgcagagtgaggcaggacatgcaccagcgtgctctcactggccatctccaggtgctaacagagggctgggttacttgcatttcattttttgaattatataaagtatatacttcggtgggatatcatgggcaaaactttatctttcaaatacttaaaatttatgttttgtattaaaccattttaataggcaaaattaaaagtgtgtctatctctgtgcatggtactgtagatggaacaaaggatggtgcagtccacacagaacagttaacttagggctcctcccttcctgggatgtgggcaggggtggggcaggggggcagggggcaagagggagtttccccctttgctttatacacctgtgcaatgtttggaacttccccacagtgagcatgcatcactctcccacatggacacagatgtggggagagcctggcaaggccatggatgtgggaagcagcagggaacaaggtgacagggaggagaggacacagcaagatgccaggtgggtggggatggtgagcaggaggcagggatggcaacagggccattttctgaaggcttcttaggtttctatacctcgtgctgggcaaaccaaacactcctttgggccccatctgactcaggctgcaggcaccggctattccataaaaaaggcctgccgacgctgcagctctcacaaagcccccagtgacaggaggccattgtttcccacttaccttggggcccaagggggaacaagtcagacaaaccatttccccttataaaatgaataaggcctaatgtagtaagactaataatctgggaaattattctaaagcataaataaaatgtatttaagagatatcaagagtaccttaaattatatgaaggtctgtggaaacttcaggaacagaaatagaatggtacatcaggagatctttaattcagaagcctagtgttactatttttaaagcaaagtcaccaatatattattttaactgaccatctgatggcagcaaaggttctattttaaaaaacagtacactagatggcagatgggaggctgtcagctagccctgggaggacaagagctatccctgacgctgcccttgggccacagacctgaggcttgagacgagacaaccctgccctctgtgggtcggtgggctctacccccaagggaggccttcaatggctgtgatggaaccaatctttcctggcaaaagagatctgaaaaaattattaccactccaccatctaaaacccatctgcttatttctgtagtaacaggctctgctgttcttgtctctcactagcttcttccccacagatttcagttcagcaaaaagatgacctcttgctgttggaacataaaatctaatggcaatctgttgataaaattagtatagtaataatccagggaatgctaagaatatctatttccgataaaattatattatctctgcctctagtctcactcagtattttaattgttttttagaaaaaattcgggccaggaggccctaggtggctctgccacagactgtcaccctgtgaccttggagatccctaagcaggatgccatagaatcctggaagccaggaaatggaaacaaatgggaagaccagaacagtgaaagtcatttcaataattctggaaaaaatttatgaagtcctatgggagaaagactctgtgaatgtaaagaaggtagtcattgtggagaaatattcggccagattccaaatctgaacctgaagaagaaaatttctgctgatgtaaattcatgtgaatgcagagtgtgtggacaagtcttcacatgtccttcatcccttaataggcacatcttatctcattctggacacaaactacatgcatgggagaaacgtggggtgaagccatacaaatgtaaacaatgtgagaaaaccttcatttctctcacaaatgtccaaagacacatggtaacacacactggtaacaggcctcataaatgtaagaaatgtgggaagacatttaagtttctctatttacttcaaagacacaaagtaatttacaacggagaaaaaccctgtgaatggaagaaaggtggtaaagccttgagattttgcagttattttcaaaaacataaaagaactcacagtggggaaaaaccttataaatgtcagaaatgtgagaaagcctttggacattctggttaccttcataaccataaaggtgctcatgctgaagagaaaccccgtgaatgtaggaaatgtgggaaacgattcagtttttgtagttactttcaaagacataaagagctcacaatgtgaaaaatcttccatgtgtttaagaaatatggtaaaagactcactctttccagttccattcagaaacataaaagaaataatactggagagaaaccctataaatgtaagaaatgtagcaaagccttcagtcatccccgctccatgtgaagacatcaaagaacacatattggagagaaatcctataactgtaaaaaatgtggcaaagccttcagtcaacacagttcccttagaagacatgaaagaactcatactggagagaaacccaatgaatgtcaaaaatgggataaaggcttcagtcggttcagttacctccaaacacatgagagaactcatactggagagaaaccttatgaatataaaaaatgtggctgggcgcagtggctcacacctgtaatcccagcactttgggaggctgaggcaggcagatcatgaggtcagcagttcgagaccagcctggccaacatggtgaaatcctgtctctactaaaaaaaaaaaaaaaaaaaaaaatagccaaatttggtggcaggtgcctgtaatcccagctacttgggaggctgagacaggagaactgcttgaacctgggaggtggaggttgcagtgagccaagatcacaccactgcactccagcctgggcaacagagcaagactctgtttcaaaaaaaaaaaaaaaatgtggtaacaccttcaggcattccagctccctttgaacacatgaaaaatctcataccagagagaaaccctttgactgtaaggaatgtggtcaagtctttagacatttcagttctctaagtaaacatgaaagaactcacactggagaggcaccctttgactgtaaggaatgtggtcaagtctttagacattccagttctctatgtaaacatgaaagaactcacactggagaggaaccctttgactgtaaggaatgtggtcaagtcttcagacattccagttctctacgtaaacatgaaagaactcacactggagagaaaccctttgaccgtaagggatgtggtcaagtcttcagacattccaattctctatgtaaacatgaaaaatctcacactggagagaaaccctttgactgtaaggaatgtggtcaagtcttcagacattccagttctctatgtaaacacggaagaactcacactggagagaaaccctttgactgtaagggatgtggtcaagtcttcagacattccagttctctatgtaaacatgaaaaatttcacactggagagaaaccctttgactgtaaggaatgtggtcaagtctccagacattccagttctctaggtaaacatgaaaaatctcatactggagagaaaccctttgactataaggaatgtggtcaagtcttcagacttgcaatgtggtgaagtcttcagatattccagttctctatgtaaacatgaaagaactcaaactggagagaaaccctatgactgtaaggcatgtggcaaagcctttagatattccagtcctgtatgtaaacatgaaaaaactcatactctgtagaaatcctgagaatgtaaggatttggggaaaacattcagttaattcagttatctttgaaaacatgaaagaaattatactggaggaaaaccgtataatttacataacatgcatatgaggaatgtgatgatgcctttatatgttccagttacctctgagcacattaaaaagcacatggaactcttccatttccctttgaaaatacgaaacaaaactactactgaggaaaaattctatgcatgtaaacaatgtggtagtgtcttcagtctttccagttctacttgaagacataaaagaactcatttctaaaaaaccctataaatgtaaagaacgtggggatgcctttgtttctctccggcacattgaaagacatgatgtatgcaaactggagatggatctttaaatacaagaaggtattctgtatctaaaccctagtagtttgcaaataaattttcattttaataattatttcaaaagtcatctgagaactcccactgagaacaaatcttataaatttaaggaatttggaaagcctgatgcaaattaaatattccacaatgctcaaaacatgcacatgaatgaaatgttatacaagttataaatatattgtgtttgtcagtggctcatttctaatgaccatctctggactgttgatttccaccttatttaacacgaaaatattgaggtgagaattctgtagataccctttaagcaacatgaatccaataggtagtgtgggtttttttgtcagttaatacaaaattttgtctgtatgtctaaatgtttttggatctacaggtgaattaaaatgtatttctaataagtaggtaacactgatttttatgtagctttttaattgttctgtaatatgtcattgaaaacagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaaatctatcatgatagtctgcttacacagccgtacaagtaataataacaaaaaattgtaaaatcagcttagagagaattatattaattatattatcgctccctagcttattaaatgtttttcctgacagtacagtcacactgttattcaaatcccggcctctgctgagcccacaggcctgctctgaacccttgcggtgcagggtctggccactcccaccagtgatgcagggaagctggcacggcagaattttaggataagagaaatggatatgtgggtcattatttaagaaagagagttctcaagcagctgtctcactgactacttggcctttaagttccttgctcattaaaaatgggatttcacatatggcaaatatattaaaaacaggtgaatgtagataaatggtagttggaagttctctgtcctattcttgaaatttttctctaagttttaagttactttaaaatgaaaagtttaaaacaatgtattcttgcgcagtatctgactgagagcgcagtacctggctgtgtccacagcagctggtctagcctggcaggccaggcggctccacagatgcctcctagaatgactctcttaaaacaccatatgattccatcatctatttggattttcaagcctaacaattttttttaaatgttattttgtatgtaaaggattatgacaaccaaatgattgtttttaaaaataaaattaatacatcaccacttactctatgaattataccagctgaatgcagatgtttaataccacaaagcatctggtaaagaaggtaggacattctttcatgatccagctccatgtgaataacctgacataagttagcatccattaattccataaccaaatacctgagggagaaaaggtcagttatttatttgaaaattatccaaagttcctttatgactaaatttcatgaaactgtaacttacttccaatcactgcactggctaaagtaaaaagataacttggtataatggaactttctaaaaattttccaaagaatatataaataacaaacttaacgtcttacaagttaaaaattaaaaaaaaaaacaacaaccttttatagcatggtaaatagaatctcaaacacaaattttcctacttcttacatttttggctgaaattctccgtaccagcctaaagaccatgctgttacaggctcatcaatcacaacacatgtaccctctggtgggagatgctgagaacgggggaggctctgcacgtaaggggctggagacagacaggaactcagtacctcccgctcaattttgctgtggctctaaattgctctacaatatatacgtttttaaaagtgattatacaacaacaacaaaaaggacacttgaccccactccccgcttagcaacgccccgattctttgctccctttgcaagcaaaactccccaaagaggtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaacagccatcatgcctggatagtttttgtatttttagtagagacggggttttgccatgttgcccaggctggtctcgaactcctgacctcaagtgatccgcccacctcgggccttccaaagtgttgggattacaggcatgagccactgcactcagccttctcccatttttttcttaatcccacttggatcaggtttgtgcagccaccattctgctgaaactgtcctcctcgaggccactgatgtcttccatgctgctaaatccactggccagtcctataatcccagcgggccctgccctgtcctgtctctaacttctcgctgtcaaaatacccagcaactggtccttgaccctcttctcttctgtaaccacactcactttcttagtgatctcagttacaggccatcagctcccaaattcctacgttcaattcagacatatctcctgaactccaggctcattcctctgcctccctattcccagttccaccttgatgtctaacaggcatcttaaagccatctccagaactgaactcctgattccatccctagcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccctctcacccttcctattacccctctgggccaaatggaccctccgtcatcccttaacagaactgctgcaacagcagtaactgatgttccatgcccccaccccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcaccaaattctttttttttttttttttgagacagagtcttgctctgtcgccctggctggagtgcagtggtgcgatcttggctcactgcaagctccacctcccgggttcacaccattctcctgcctcagcctcctgagtagctgggactacaggcccccgccaccacgcccggctgattttttgtatttttagtagagacggggtttcaccgtgttagccaggatggtctcgatctcctgacctcgtgatccgcccgcctcggcctcccaaagtgctgggattataggcgtgagccaccgcacccggccagaccaacttctttatccccttcaaggctttcttcgaatgtcaccaactcatggaggtctttccccagccaccttatttaaaactgcagcctcaagtccaaccctcagcacttttgatcccctgacccagctccaccctttgtccacagcacctagcacattctaatggactacatgctttcctcatttatcatgtggcttgtctatcttccctgacaggctccagggaagccaggtaggccaagtcccagagagtgcccagcacacagagggcaatcagatatttgttaatgactgaacacaccaataaattcaggatgaagttgggcattatgcctctcaatagattaatacttcatttcactgttagtaagatgattctacttaagattctggaaatacagaatcttaaatagaattagtgacttaatcattttaagtaatactcataaactcctgaaccctaaaatcctggctatcagggatttgagaaaaacattttatagttcagcaaaacacattagtgatcctggtctgctctgaagaattctttccagtcatcctttatctgttatgaagatgaaaacccatgtggtacaaataattaaatataactatcaaattttctaaatatttctctgcaacagagaaagttatctgtgatgtcacaaaatgtattgccacctacatttcctaagtataaaaagcagttgctgtcttttctagatgttcattctttgatgtacagtgcattactgaataaaaatgatacttacacatcttgaaattcttctagagttttttgtggtgtaaacacatttaacaaactaattatctgaaaagagaaaattaattatacttcaatatgtcagattacttgattacaaaaattaagtttaatattgaaatgcattaagacgggaaaaaaatcacagcagaattcagtacttcttattattactgcttttaccaattacatggcatttgagaaaagttaaacatcaattaaaggaaagatgcacttttaatcaaatcacttttatgtgtccctagtaacttaattattacagaatttaaacacataatgtctttttgaacataaaaaagtagaatttacaggtaaaaagacattaaagcagtatgttaactctgaaaacttaaatactacgcacaaatttctaaaaaggtttgaaatatgaaggctaagctcttgtttttggtgtgataaagtgaaaggcctcgtagcatcatatttttacctaaagagggttaaagagctgatcctgcggcaggcctccatcctggcaccctgacatgatttggctgtgtccccacccaaatctcatcttgaattgtaatccccataatccccacgtgtctagggagagacctggtgggaggtgactggatcatgggggcggtttcccccgtgctgttcttgtgacagtgagtgagttctcaggagacctgatggttttctaaggagcactgcccactttgctctttacttttctctctcctgccgccttgtgaagaaggtgcctgcctccctttcgtcttccgccatgattgcaagtttcctgaggtctcccacatcatgcgcaactatgagttatttaaaccgctttcctttataagttacactgtcttgggtatctctttatggcagtgcgggaacgaaccagtacacagcccatggtgtaaacagcgagtcccacggcttaggcaccaaacacataacctcagtcattccagatgactgagggaaagatgaattatccattatacaggattggggtgattggttagctaaggacaaaaataaaactgcatccatatttcaatctttataccaagaaaaactctaaatggaacaaagacttaaatctaaaacatgaaataaaacctcagaatatagataaacatttatataatcctagcgtagaaaatcttttctaaacatgacaggaaacctaagagatctgattacattaaaatgaaacaaaaaatgggtgataaaaaatcagtatgtcaacaacataaataatgtcaaatggaaaaaaaaaagtaaagggcaatagttttaatatttaaaaaaaaaaccctcctacaaatgcagaagagaccagcagtccaaaagaaaaatggataaaggccataaaaattaaattaccaaaacacataaaaataagtaacaacctcaccaataaaaataaaatatcatttatttatcaaattggcaaaagcaaaacaaaaaaaatcaacagtatgtagtgctgggggattctgaagtaacagacgttctcagacactttttttttttttttgagatggagtttcattcttgtcccccaggctggagtgcaatggcgcaatcttggcttactgcaacctatgcttcctgggttcaagtgattctcctgcctcagcctcccaatgagctgggattacaggcgcccaccactacgcccagctaatttttgtatttttagtagagacggggtttcaccacgctggccaaccaacgtggtcttaaactcatgactcaggtgatccacctgccttggcctcccaaagtgttgggattacaggtgtgagccacagcgcccggctgatacttttttttttttaggagatggggtcttgttttgttgcccaggtgtgccttaaactcctggcttcaagcgaccctcctgcctcagcccaagtagctgggattacaggtgaagtgaccgtgcccagcttctcaaatactcttaatgaaaatatcaaactaatagtcttccttgaggtcaatttgtcagtatattttaaactagaagtgtgtgtactctgacctgacaatgttggccaagaaattcacctggacgagtatgcaaaaattcaggcgttagaatgttcattgcagcactgcttataacagtgagaaacaaaacaatctatccaacaacaggcggctggcagtctcttaaataaattactgtgcatctgtgctatgcaaccatttaaaaactggctcatatctatgttcattaaagtatatgaggtctaccaacattgcacgaggagaaaagcaggatgaagaataacacgattaatcttgtttatgtacttgtgcacatgtatgcataagaatgctcaccaaactgttaatgctagtaatctgtgggtggcggtattcaggagtttttacttttttatattgtttgaatttttaaaaataatatatattttttgtaacctgaaaaaattttttaaataagtaagtaaaacaagtccgggtgcggtggctcacgcctgtaatcccagcactttgggacgccgaggcaggcagatcacgaggtcaggagatcgagaccatcctggctaacatggtgaaacccctgtctctactaaaaatacaaaaaattagctgggtgtggtggcgggcacctgtagtcccggctactcgggaggctgaggcaggagaatggcgtgaacctgggaggcggagcttgcagtgagctgagatcgcgccactgccctccaggttgggcgacagagcgagactccgtctcaaaaaaaaaaaaaaaaaaaagaaaaagtaaaataaagcatgcattagagaaatttaaaccaactcaagccacagactcaaaagaaggaagctcaggagtttaagatcagcctagacaaggtggtaagaccccacctctacaaacaattttaaaaactgccaagcatggtggcgcacgcctatggtcccagctacttggagggctgaggtgggagaatcacaacctgggtgacagaatgagaccctgtctcaaaaaaacaaaacaaaaaaaaccagatttcacgttttatattttatttatttatttatttatttattttgagacggagtctcgctctgtcgcccaggctggagtgcagtggtgctatctcagctcactgcaagctctgcctcccgggttcatgccattctcccacctcaccctccttaattttttgtactttttagtagagatggggtttcaccatgttagccaggatggtctctatctcctgacgtcatgatccacccgcctcggcctcctaaagtgctgggattacaggcgtgagccactgcacccggccaacattttgtaattttataacatggcaacgttatcaacataatgctcagcgaccactaggagaacaaacaatgtgcttgattgaacccaacttcattttctagaaacattatttctccgtaaaatttagtgctttgatttctgtggagcttccaagaatagctactctaaatgtaacatcatctaataacgtgtatttgaaactggtgtgtcatatacaaggtaaaaacctacttatagaacaacatctttccacaaaatatttagttgtttctcaatttgttagatcaatactgttcctattttatagaaacagagtatcaattgatattcctactttggttaagtgacctaaattcctatgcaccataatgatgcctctttctagctttgatttcctcaatgtttattaagaattttatcagccgggcgccatggctcacgcctgtaatcccagcactttgggaggctgaggctggcggaccatgaggtcaggagatcgagaccatcccggctaacgcggtgaaaccctgtctctcctaaaaatacaaaaaattagccgggcgtggtggcgggcgcctgtagtcccagctactcaggaggctgaggcaggaaaatggcatgaacccgggaggtggagcttgcagcgagccaagatcccaccactgcactccagcctgggcgacagagcgagactccgtctccaaaaaaaaagaatgttatcaataaaaaataggccgggcatggtggctcacgcctgtaatcccagcactttggaaggccaaggcaggtggatcatggggccaggagatcaagaccatcctgactaacatggtgaaaccccatctctactaaaaatacaaaaaattagccgggcgtggtggcaggcgcctgtagtcccagctacttgggaggctgaggtaagagaatggcatgaacccgggaggtggagcttgcagagagccgagactgcgccactgcattccagcctgggcgacaaaaaaacaaaaaaacaaaaaacaaaaaaccaatgttaatagccatttttatccttagcttatcctaggtctgaactcaatgtatctccagaaaaccctgaagattaccacattattgacaatatggaagcacacagacaaaatacatacataacttacatttttatgattgacacattttaagaggacaagttcacgataagctctctttgcatgagtttggttctgaaaaggacggcttagtttcttgactgcaacatttatcccaagaactgtatcaaatgcagcactagaattaggaaatataatgcacaatccattagaacggttttggaaaatacagcaatgccagaatatacattgaatatatcatctttttaataagtaacaaggaaaaatctgcttatttcattcaaggtacttgcacatatgaagagcagagtgagttgtctaagactacagcatgtactaactcctttgcagaggcacatttcagccacagttaagatggggttcagcaatccttcacacaccaaggtttcatagtttagattacattcaaaaccaggtaatttaatatagagtgcataaaaccagtcaagaaatgaaatcttcagtttaaacatgacaagaagttggaaacaaagtcactgtttcctgtcttaaaatgtgtatattttggaatatcacagtagaggaaatggctgaattcatgaggagaataaatctaaattttgaatcactgtgtttttttcacaaataacagtatctaaaaagaaaagaagccaaaatttcagctcatggtaaatgttcaagatacaaaatctctaacgtaagcaactgctatataaagttcttttagaactatctcctcctactactatagtaagaataaaatctacaggctgtgtttccagcatctcgtttcctgttgaaattctgttcattttcctccagaaaatagacatgaagaatcaagtagcctgattacacatttttaggtttcaaactggtactaaatagtatcatttgtattatcacctctgggctactcatgagggctaacagctactaaaggccacctgagaacctaagcactgatttaaatactgtttctatttctttattccattgagtttataacattgtttacatttattctcttctattaatgcttttgccaaactcgaacctaattcaatctgttttaaagttgaaggctatctgttgtagcatttggttaagaagctaccttactttaattcagttcatattatgtgtctgtctatatacatatgtaaatccacaggttcatatgcaaattgcaccatttatatgaattataaaatgagaaggatatatccacttgtgaaacaagtcattgacatacatgtagccatgtatgtatttatacctatatacttctcagactcaagaatttgaaaataggccaggtgtggtggcttatgcctgtattcccagcactttgggaggccaaggcaggcagatcgcttgagcccaggagtttgagaccagcctgggcaatacagtgaaaccttgtctgtacaaaaaatacaaagattagctgagtgtggtggtgcatgtctgtagacccagttactcaggggactgaggtgggaggactgcttgagccgggggtcgagactgcagtgagcactgatccctccactgcaccccagcctgggtgacagactgagaccctgttgcccagggtctcaaaaaaaaaaaaaaagaaaaagaaaaagaaaaaaagaatttgaaaacagacacacttttttggtatcaaaagtttttgtccaaaatttcagttagataggaggaataaggtcaggaggtctactgtgagatatggtgactgcagttaataacaatgtattgtattcttgaaaattgatgagagtagatttgttctcatcagaaacttttaaaaagtatgtgaggtaatgcatatgttaattcgctcaatttagctagtccataatgtatacatatttcagaacaatatgctggacatgataaatatatacaatttttatttgtcattttaaaaaagtttttggctaaaacaaggcaaatggaccaagtctaagcatctaagtgggcataagcttccccacttgtagctcagctccatgaggaactaccttcagttattcctggttgtggttattgcggtcactcaaagaatacattgttatcactatctcttcatttatcagctttagaaatgattcacctactccccattacgaaaactgagtatttggccacttccttgaaatccccaatcgccaacacctcctattttttttgttgttctgctttttgggttttccctggttacgtctttaagtaacacccctaatcttcacgcttcttcaactctgaagggaacgtcttgacttctgcttacgtaaaatgagactgttccatccctttctcctccatttaccatatattcataactaagtcttctgtatttcttctttaggatgtttctagaagttgaaaatcaatacatggagtgtaggtgtgtatgtgtacaatgtaaatatcactaacggccagagttgggattacatttcattttctaaagatcacatggctcttgctgccactcataagagggtgagactatttccaggatcaaggacaaaggattctcttatatttcatcaactgctcaaacatcatgtcctctttgtttcataattagaccatgattttttctagttttccccacacatttctaataaataatagattttattacattctagattattattagtttttactaataaaaaatgccagttttagcctatcattgacacatcttagcttctcacattatctgttgtgtggcacctactccacatgatttgcagacactctttagcctatcactggcacttcctagcttcttacattattgttgtctggcatctcctccacatgatttgcagacactcttcttgcagcttccttaagacctgccatgcagccaccatcctgggatttcttttcacagtccccactgcttcttgcattacgctcttgtgttgcctctcttgctggagtacatcctcaaggaatttcctcagaaaaggtgcatggaagatagatggtattgctctgcccccacccttgattgataataagttttctgagtttaaaatcaattttctgtgagaactttgaaggcacttttccactgatttccacactgagtgctgacagtgaggaggcttatgcccgatactgtactgattcctttgcttctttttttgtttcccagctcaatgatttatcagtcatgttctctctgtatcccaaaagcttctcacacccccaactaattagtgtccctcctgtccaccagtgataactgctttgacatgtacaataatcactttcttgctttaccagctaaagcatgcaccctggagctcccagtttatttttgcctgttttttgaaatcttctgtgtctgacttctgtggctcaatattatgggactcatccattgttgctgtatgtagctataactccttccatcattgctataagattcctttgtataactatatcacattacgttgatagatatttcagttgtttttagttttcaatctattacagaacacacagtcatcaccattcctgtacgcagctccggatcccctatgcatgtgtttctgatgagtagacaactaagagtgggaacgtatccattgtatttcagtagataatgtcaaactctttgccagagcgtttctacaaatttgtacagctgccagcagtgcacgaggggtcacatctgagagctgcctctgcgtggttccagtacacgaggggtcacatctgagagctgcctctgggtggttccacatcctcaccagcacttggtatcaccaacagcttagtttctaaccattctgctgagtgtggaatggtatttcgtcgcagttttaaattgcactatcttgatgaataacggcattgagcacttttcctgtttataggttatttgggtatcctcctgtgacaacctattgactatttgtttgtctatctttataatcttcttgactgttgttctttacatattctgaacaagagattttttttcagtcatatatcttctcacatctatgcttatcttttcagtttcttgatcttggttttttaaaataaacaacatttcttaattttaatacaaaattgatcaatcttctatgataatttttttttttcttaaagtggagatggggggagtctcattatgttggccaggctggtcttgaactcctggcctcaagcgatcctcccaccttggcctcccaaagtgctggaattataggcatgagccaccacatccagcagataaatgtttttttatgttgtgtttaaaggagtccttccctaccccaaagatcatgaagacattctcctatattatgttcaaatagctttactggcttgccttatatatttacagcaattcaactgacattcacttttgtgtataatatgaggttggggtcaaatttcacttttttctacatgaacattcctatgtccatttatttaaaaggctagcctttcctcattgctccacaggccaccactgccataagtcagaagcccacacatgcatgactctgtttcagggctagtccactgtttctccttgcaccacacgacaccagcttgatcaccagttttatggtaagtcttcacatctcgcagagggagtgttcctcccttcttaatgggtgtcttgaccattctagggtttttatttttacatataaattttaaaatcagtttgttcatttctttgttttttaagacgactgagatttgattgcaatcactctagacaagtctgaaaaatgaccttcatggtattaaatattctaactctgaaaatcagacatcccaccacgatttcagttttctctattttttctaatttttttagctttttgtatacaagtctttcatattgttagatttttcctccagatatgataatttaaaagtttttatcctattttaagtggtatccttttcaaattttcattttctatatgctgctagtatataaatatgcaattttgcagggggaggggtacatatactgaccctgcatcttgcaaaagggctaaacgtactcattaatttaacaaaacgcagattatccaggtgggcctattcttatcacgagagccctttaaaggcagagtttgctctggctcatggaaagggtggaaaatcagggagatgtgagtatgggaaggactgggcatgccactgctgccttgaagatggaggaggtcacttgagaaggaaaacatgcagcctctgggagcagacagcagcgcctgactgaaagagatcaagagattgggaaccacagacctaaagctgtaaggaactagactctgccaacaggctgaaggagcttggaagcagatacccttccagaacctccatctgtgagctgagcccagcccagtcgaaatcttgacttcagctttgtgagatgctgggcaaagaacccaggcaaacccacccaggtttctgactatagaactatgagataatcaataggtgttgttttaaacaactaagtttgtgttaatgtgttatgcagcaatagaaaactaacaccttctctgttttgggctcttctaccatttttgcctctgcagctttcattctggatactttttgctgacctctcctccaggtcactaaatctctcttcagttatatctagcatgctgttacacatattaaattcataattcaattactatagtttttacttctagaattttgatttattcctcttaaaagaagttttcatttctccaccaaaacttttaatcttgcctttatcaccttgaacgtaatatcatagctatttaaaaatgtggatctaataatgccaatatctcctatggatctgtttcttttgtctgctgtttctgcaggattttattcatgttgtcatatctccttgtgtgcctagactgggccttgcacgtataaaactgtttgctatctagaaataattttatctaatatgatgctgtcttcttccacaaagaatttaaatttatttctactaggtacctgggggcactagcaatttttgtttacccccatacaagttcagcaaatgagatgataatctgaagctgagtggcagtgcctataagggccaatctctgagttacctttacttctaggaagcagccttttattggtcccaacacaagtaaaagaagtttgccacacaatattagagggccctggactctcatccctgtctcctagccacagggcagtccaaaacactctctcaacagccccttccagaattttcaaatgcccccaagggaaagacagccccacatgctgaagctcccctcactaggcttctgtgcttccccagatcctgacctagtaactcctcactaacttactagctctctaggggaaaatgctgagcatgggggacagtgggaatgttggcagaaaactggcacagctgtttcacaggcacacttttaattaacagccctagttttagccactcatttcatctcttcttcattgtcatctctatgcccacagcctctgtagttttactatagctaggttctcttccttacgcacatacttcagctgcttattctcactttatctgctgttttatctgtatcacaagattcaagctactttctatatttcataaatttgttaaaactgtcttccacttattactgccctcttatctttgtacaggtgttcgggccaccatcttaaatgagaagttccaaaccactcattttacaggtgaaaatattgaggcccataaagaaactgatttgccctgctcacaaagaactcttcgctgaggaaaagagctggactcagaactcaagtcttctgaatcacagccatcctgtgcctcaaaccatgtctcctttatcacagaaattttgttgtgaacattgttatgtttttatttatttatattaatagaaaataaaccatgttaagaacaggccagtactcatgtttatacagaacttgaggacacaaaaaggaacacgctataccaattatttcatgttaaggctgtaactgttacttctaagaaccgccagactcaatattgaacacttttttaaaggttaagcatttcatagaatggtttcgtaaagcaaataatctttactattttggccaaacttgagatttttgaaggagaaagaaaaactgaatatatgtatgaaagaaatgtacatacattttctccactagagcttcaaaatcttacaattatttaattgtactataacacagttgatatttatgaatacttcaaaattatattttaaaacttattttaggccaggcgcggtggctcatgcctgcaatcccagcactttgggaggccaaggtgggcagatcacgagatcaagagatggagaccatcctggccaacatggtgaaaccccatctctactaaaatacaaaaaattagctgggcgtggtggcgcacacctgtaatcccagctactcgggaggctgaggcaggagaatcacttgaacccgcgaggcggaggttgcggtgagccaagatcacgccactgcactccacctggtgacagagcaagactccgtctcaaaaataaaataaaatattttaaaatttaaaaacttatttcctaataaattttactaacatatttaaaggaacaaaaacaaataaacaaatcaaagacaactataaaaacaattcaaaattaggaaccagaatattttcttctggctccagctcttccatttaatcctgtacaggtcacaggccctacctgcacgttggtttatctgcacacctgcccttcataaagctctaatttaaatagaagattaactagttgcataaaccatacactgttgctgttatatttctcaaaaatgtagaaatacacatgcttgtgaattagtttcctattgctattgtaacaagtaaccaccaatttactgctttaaagccacacaaacttactatcttacagttctggaggtgagaagtccaaaatgcatcttatgcctcaagaggtaagcagggctgcgtggctccttctgcaggctctggggggagtctgctccctgcctctctcagctggttggaggcttcctgtattgcttggctgtggccccacatcactccaaacttcgctctgccatcacatctctgactatgaccttcctgtctcccttttgtaagaaggacccacccaactaaacctgggataaccctcccatctcaagaccattaatgtaatcacaccggctaaattccttttgccatgtaaagaaatatacaaattccagggattaggacgtggacatctcaggcgggaccattattctgcatgctacactccccaaagaatcactgacagatgattttcaagtacaatagtgatgaaaggaagtttcagatcatcaattaactacataatgccaatattttaatacgaaatatgatagaaaatccaattcctcttgtcagtgttagctaatctactgttgagcttatttttggaaaagcaagcttttttttcttttttgaaacgggaatgtgccgtaactagattatttcccaattctacttggtgcctcatagcctggtgaaggatacagagaaaagagaaaggtgaaaaggaagcgaaaatcacttataaagtgtttactttccctattagaacataagatagaaggataccataaaactgaaagtcagttatagctataaaaattgaaactgttcttgaatgtaacaattgtcttatagagataaatacaattaaatgaaaattgtttaataggtgtttagtgaatatttgttcattattactaagattctaaacagaaggtgggtcagaggccttgacctatcaaagtatcagtggttcaaagtcttcaacaagtctctccgtggtacaggcaataaggtcccaaaggcccacagcttgttttggtcccaggcctaccactaacaccccgtgagacgggagaagcaagtgagccttcctagtccttcgattcaccaccagtgagggttatggcagagctcatggtgattctacaatatacactattcacattactaccaaccttcaaaagcaagtgaatgacatgccagctgggataaatgaagcacgtatttaaaacagctacctgtaggccgggcgcagtggctcatgcctgtaatcccagcactttgggaggccaaggtgggtggatcatgaggtcaagagatcgagaccatcctggccaacatggggaaaccctgtctctactaaaaatacaaaaattagctgggtgtggtggcgtgcgcctgtagtcccagctaccgggaggctgaggcaggagaactgcttgaacccaggaggcggaggctacagtgagctgagatcgcgccactgcactccagcctggtgacaaagtgagactctgtctcaaaaaaataaataaataaataaaacagctacctgtctatagccacaaacaactccccaagacctccgacatttctcccttcttgccccctctctcctttttctctctctctctcgcatgcacacatcaaattatctgtcaaattatcatctaattccaaataggagatgggttataaaccaaaagaatgctttgttgtttataactttccattaccatcaaagtttcctaatttgaaccatcctccactaactttaaaacttttttttttttttttttgagacggagtcttgctccatcgcccaggctggagtgcagtggcgcgatcttggctcactgcaacctccatctcccaggttcaagcgattctcttgcctcagcctcccgagtagctgggactacgggtgtgtgccaccacacctggctaatttctgtatttttagcaaagacggggtttcaccatgttggccaggatggtctcgatctcttgacctcgtgatctgcccagcttggcctcccaaagtgctgggattacaggcgtgagccaccgtgcccggccacctttaacacttcttctggcacactggatttaagtgccgatacagcatgtgtcatcaggaagttaagatcaccattactttagatgcaagctgggcattccttccaaacagtccctttcccgccttagcttctcaaagaagctctggactgcaatttcctcttagctcccagggccttcagccgccagggctgaaaaaaacaactgtttccctgatcataggtctccgcaacaaaggatcagttaaaaatcatcgttaaagattctccaaacccaacatctctacaaggaaatgtaaactaccctactagagcatcgaaaagagctttcttctccctcaaccccctctgcctaccagctgtaaacacgcgatgtttaactgcaccacggtttctttaggcgcaaaggtaatcctgttttcattgaccaaaaaaaaagaaaaagaaaaagaaaaaaaaaagttctgcccagaaaaataaggggtaaaaagtgtgggaagtgctgatagctgcagtctaggaaacatgtgaagagctttaccttgagctggcccgtgatgctgcggcggctgaccgtcttaccatgcaagagactaacgttcagggtcagactaacgattctgacgttctgggctggacacacagttgaagtgagacaccaaggaagagatggccagcccaacccctcacacagcatcccttcctggttaatccatggagtgacaatgacactgactggcctcatcctgccaatgaatggcaaggcactgcaatgatggcgcctggaaatgaacaggagtgatcgggaataaaaggggaggggggaaaaggtggccatgatgaagaaatgaataaaactccaaatttctgttacaactcactgtcatacctactactctgatatcataatgacaggagaaatgaaaaaaaaaatgaaaggaaaaagaaacaaacaaaaaagaaaacttgctacctatttaaattcctgcagcattctaagaatatgggtttgtaccctacagcctgactacacagaactagagcaagcagttgattcaatttagctcataaacctataacagagttttttttttaatcatcaatgtttctaaatcctgacactttagttttactttttattacagcaaaaactcaatccacgctattaaaacagaccatacttaccaaacaatcccttgggccccagagccaattggtttcagctgctggtaacgttttaggacagtgaaggttgagtctgccacttgcacactataaaactgactgtcacatttactgtcgctcatgatgcagcgtcctgcaatatcccgaagggtgggcaagtttcagatcccttcaaagaaaaacagaatgaacgtgcattcttaccggaagtacatacgcagctcacgtaagagagttctgaacttattggtatgtaagacaatgtggctgtaagttgataaagtcaatctgaccaagttctgaacttaagcaagacacaaaaaaatgcagacatttcagtggtaccagaccattatgaaaggaaggaattttgaggcccagcaagaccacactttaaggggctggactagaaaataaccacctttggagaaaagaatgtatgcattactactggctatgaaaagactacatcactctgtgcgtctcatcagcttgccccctgtgggcaagctaggtgtaaatggttcatttacacctagctgtctagagacggaggcattgtttcaaaaatgatcacttctagaatgcctaaagagaagcaaacggaccagtcttctgctcagtgtatagattctggttgaaatgatgaaccaaaaagcaagattcatacgccaaagtgacaggctgtcagaggcctggtggcatcagtgtgctgcatgtgcccaagcacgtgctcctgcctcaggaggtgggtcccagagctggcatcagctggcacagccccagagtcccacatcaccaccggacttcagggtagagatctgtatatgaagaactctgctgtgactgacagtccatcatagtaacactaggaagtctatccactatgtctgagtgtaggccagcaggcccagaaagcagcttttctgtggttgaggcacaggctgagactgctgctctgcaggagcctggatgattttatacagaaaacaagcaaacaaattggcaagtggttcctaggctcgtgtctggttatgcttatttaaaagtcagcaagctatttattttggtcttttaaaactacatagccaacaataaaatcatataggtaaacattctataccgtttaagactacagaatgtattctacagctctgtcaaatcccttgcctttatgttctagtatctaatatttaacgtcaacctaatgagatttttgtggtgatgatttatatttcaacacaaatgctaggattttccttaaacatggaaaaaatggattaataacaagtctaaataaagaactgagtcaaattaataatttctccaagtgaccactgccccacggtcttctccccgtcctctgggtggtggctgcagtgtggctgccactctgaccactcctgccgaggtgtgttagcgtgccagccagggagtgactccagtgacgccacagcgcttagatgctggacaaacagctgctcatacaacccgcaccgcaggagtctcagtcccgtgttacctgggagcaatctagggctgagtgagctggaacacctgcctagcccacactgctgtgagaaggggactcaggagctctccaggctggcaggtcactgtgctctaagctataggaggtgcgaggcaggtctgtcttgctcatggcatctcatactccaaggacaggaggacaggaagctggtctttggggcactgtgagcattcaataaacctttgttgatctgattccccacagtgctgctccattttactgatatctaaaggaagatcctttctaaagattagcttatttacagtttgcaagaggctgaaacaattccactcaacatttagggggtacctttatgcacgaaagtggtaagtatagcaaaagatatgccatagtcagctagcaaccagtcttgaaacaacatgtacttcactatttgggggagaagcgcgagcagtgagtccattatctatattacaagtcacagtgcggtaagggccataagcacaatgtaaacaaaatcaaaaggcaaaagagatcctacccactggcaggggcagaagacaaggacggcttcaaggaggaggcggcatccgccctcagactcttttgccagagatggacagtagagccacagagctcaaactgactgtgtccagacacagcgaactgctgagcttggctagcggggtacaagtgcaaaggattagagacaactcagcaaaaaggcaggcacccactaccacctgctttacggagggtggctgttcctctgctatgccgtcaacacaccagcaacacagttacttgcaagcatgtactgagcacccgctgtggatggtgaggtaccatgccaggacactcgcctgccctcagtgagcgcacactcaggaggaggccctgcacaccaagggtcctaaacccagtagggtgaagaagatttgggggaatgggaggagaagcagcagaggcggaggcacattcggaatgtgacaagtcactagggacttgctgggtagagggcgagtgaagctggagagagaaaaggaggccagatcactatgagccccagaagccacgcagagccgtctggcctcagtcctgagggctgtggaagccgtcaaaacatcagaggtgcgacacaggcgctgaggtgctccaggatccatccctcccttcctcgctttcataagagaagccttccttccccttcctgctagataaatggctgcccaactagagacgacgcctggcagctttcccagcagccaggtatggccagatgaccaagttctgactaataagatgtgggtagaagtgatgtatgcaacttccagatcacttttatttttctttacagaaagctgcttgccctccaatctttcttccttgctgctggctgagggatcagctgtcacagacccagagatggaagtcacatgctgtagatggaaagctgcccaccagctggattccttaactacctcatggcacagagccaccccccattcaggaccccgtgtccacgttgggactgacagatcaatctcaaccctgctgaccaactctgcaactctccctgctataactgctttcaacctatatttggactatgacaatattaggttaacttttttaaatttggggagtatattcactcatattaggttttagaattgtaattccatctcaagatttaaaatagtccgggcatggtggctcacacctgtaatcccagcactttgggaggccaacgtgggggaatcacttgaggtcaggagtttgagaacagcctggccaacatggtgaagccccatctctactaaaaatacaaaaattagccgggtgtggtagtgcgtgcctgtaatcccagctacttgggaggctgatgcaggagaatcatttgaaccgggaggtggagattgcagtgagctgagatcgtgccactccagcctgggccacagcgagactccatctcaaaaacaaacaaacaaaaagatttaaaataattataaaattaaaataaggtacccttattatgcaggagaaaaaagtcacctaagtgaaaacctgttaaagccaccttctctgtcaagtttgggctttgtgagagcaagagaaagaaacttaaggccacctgagaaggtgtgtaatttagctattcatgagtcaactctattgagatgatatttcaacaaaatggaccatcaactggggctcagaaaacagttttacaaatcgggaagtacaagaattcttcatgaaaccacattagcaatacactaaagcctgcattcgctgcctccacttcccacaccagccggtgctggttcctccccctcagctcccaggctgtgctgccaccatccgtccagcacagggctccctccttgccacttgtgcactcagcagcgcccgccaggctgcactgtcacagcctttgtagggtctgcctcccttccaggctatgagcaactcaaaactgggagggaacgctacaaggaggtttcctggaggaggcaagacctgagctcaagtttgttcacagtatcgaccgaggcatgaggaaacaggcactttcatacacgtcagtgagagctgagaagtggtaaaacatttttttagatggaatatagatctggctaataaaaatgttaactgcatatcctaaactggcaaacacaattctctaagtgtatctgacaaatacgtgtacaagtatccaaacatatttgtgcaagcatgtttgtaacacttcttgtaacaggcaaaaaactagaagtaatctaaaatgcacactgtggatggactgaataaattatggcacagaagtacaacaaggccattcaacagaatgcaaggactttatgtatcaatgtggaaagatgtctaagatacagaaaggaaatacaccaagttgaagaagagaacacataatgcccagctacgtaaacacacacacacgcatacacacgcacatacacaatgctggcaagtagagaaatagtgggaaatgagaaactttcttcccattataactttctattctgtttttcaaatgtacatatttcacatttaaaaactgattaaacaacacatgttaaatgaaaagctgcagaatgatcatttgacacttgtatggaagacgggcttcaggcagataaggctagaggcatgagagtgggcctggctctgaggtacacatttatcaacacccttataacaactagtgagaagcatattactatccccgctctgcaaatgaggaaactgaggcttagaggaagttgtccagtaaggaagttgtccaaattcccagcatggctcagatttgaatttaggagtgtttcaccacaatattcaagttcctcccaaagcaccattctgatatccctttagaaagtgaagctatttgcacatgggctggccaggaccagcacacagtcctgcacatttcaccttgctgactccccctaccaaaacctaccaaaacactttttcctctaacgatgacaacgattcagtgatccacagactcaagtgaacctttcatcacactaaagcttcagagtacccaggacatgcgatatttaaatcaactaactattgtgattaaaagcagattctcacaatcaccctctgtctcaatgcttgctgccgacatttttttcattaaattgttctgttttccagctgggcaagatggctcacacttgtaatcccagcactgtgggaggccgaaggtgggaggatcacttaagcccaagagttccagaccagcctgggcaacatggtgaggcttcaactctatattaaacaataataataataataatagtaaaaatctggccgggtgcggtggctcacacctgtaatcccagcactttgggaggctgtggcgtgtggatcacgaggtcaggagacggagaccatcctggctaacatggtgaaactccgtctctactaaaaaaatacaaaaaattagccgggtgtggtggcgggcgcctgtagtcccagctactagggaggctgaggcaggagaatggcgtgaacctgggaggcggagcttgcagtgagccaagatcacaccattgcactccagcctgggcgacagagcgagactccgtctcaaaaaaaaaaaaatagtaaaaatttaaaaagttctattttcctactgtaattctttattctttcttttctttttttttttttttgagacggagtctcgctctgtcgcccaggctggagtgcagtggcatgatctcggctcactgcaagctccgcctcccaggttcacgccattctcctgcctcagcctcccaagtagctgggactacaggcgcccgccagcacacccagctaatttttgtatttttagtagagatggggtttcactgtgttagccaggatggtctcgatctcctgaccttatgatccgcccgcctcagcctcccaaagtgctgggattacaggcgtgagccaccgcgcctggcctcctactgtaattcttatgaagaatagcttggtataacaacgtaatctttctttgataatcaagaaccttgcagctctcagggccatcctctgtagttcttaagccacagtatataccacaatacagaacaactagcatttggttatcacttcacccactgttggatccataggaccctgcaaggatctccgtcaccagccccacttccaggcacccaggcctgcctatttccctctcaatcccccactcccagggccctgggtaagggcttctcgtggctccttggaccagcgacagcagaagcattctcccagccaccatttctgtgacttccgaaccactgcacacatgccactttagaaagagaaatcactccacgtgagaatatgtacacaaatgttcacagcagctttatttttaatagtgccaaactagaaacaacccaaacctgtccttcaatgggtaaatggttaaactaactgctgtatacccataccatggaataccactcagcaactgctgaaacataccacaacttgggtggatctcaggggcaggatagtcaacgaaaaaagccaatctcaaaaagtcacatcctgtataactccatgcatataacattcctgaaaagacaaaagtatagagatgcagactagattagtacttgccagcagttatgaatggtggggaaaaggggctgctgtggctgtaagggggtgggacaaggagatatctgggatgatgacatagttttgaatcttgattgtggtagtggttataggaattttcacacgataaaaaatgacaatgaactctatacaccttgctccgatgcccaatgtcctggtttagacattttactacagttgtgtaaatatgtaaccgtgggagaaagctgggggaagggtactgggacctctctgtgccatttgtgcaacttcctgtgaatctataattatttcaaaatatggaaagaaaaaagagagatttgttgaaagtgtgcagtgatcacaccattctcccatttgaactccttcaacagtgactgactgcctggagaataagattcagttccctagcacagcacaggagatggcagtcctctggcccaatcttaggcaacatcaaaccacctgggatcagcggacacacccagctactgcacaccttcaggcctctgcctaagctgttccatctgcttgaaatgacttccctcccctttttgacctgctggtcaacattcaccctccttcaaaaatctagttcaagcacttgcttctcttacatgtttcctcctccagcctttcccttcaaaccatgctgggcatgcccccatttttgccaccctcccagtattcgctttagattgcattccgagtctacttacacttctactctgtaagggcagaaaatgtgtctgatttatttctcaatcctctactgattacacagtgggtgcccaaaaaatgtttgttaaagacaaagctaaatgggagaaaaaatgcggtagggcagctgggagcagtggttaagatcgggactttgacttcagactcccagtgggtctgctatttatctgggtgatgtgcagcaagcgattgcactcatctgcaacacggacgagcagagagcctcagggtacctctagataagaagtgcacagcccacttaggaaggcatcttgatgcaggaatgcaccctaaatctgacgaagcctcgtctagatccaattactaacttacagagattacagagaaacacattcaattacactgcagagatgcaatcaatcaaataccaactatggaaatgctaaggaacaactcgattgcttcaacaaataaactaccaagaaaacaaagaaataggagggggatctatggattaagagaaacttaaaagacgtatcatccaatcaacaacgtatggccttctcttgctctactttcaaactattaaggaaacctaaaattcatggggcagctggaaatttgaatattgactagttatttgatgatattaagcaattattactttttcaactttaaaagagtcagtacctttagagacctaccgaagtgtgaagtataactactgtacacctcctgagcaccctgaggttgtgcccgtatgttttacagatgagtgcaatcgcttctgcacatcacccagataagcagcagacccactgggagtctgactcaaagtcctgatcttacccactgctccgagctaccctaccacatttattctcccatttagctttgtctttaccaaacatttactgggcacccactgtgtaattagtatcccaaaaaataatgaatgaaatgacatgatatttaggatttgcttgaaaataattatgggtggtaagggtgcaagtggataccattagagatgaaacaagattggtcaggagttaataactgttaaagcaggacactattctgtttattttgtatatgtttgaaagttcccataataaaagttaaaataaaaagaatgatgttgaaactggttcatacaatcaagtacaaagtatcaggaattaattattctgaaggaaaattatgtaaaaatggcaccttcctaaccaagtgtgaggtgtaactactgtatgtatgtagaccaaaaatagttgccctattggcaaatcaatagtctcaagaagaaaaaaaatctggtctctgttttatcttatgcctcatgaaaacaactggtttactcgctattaactggtttgtctggtccttttctttatccagaaaattaagaatattttatcttagacacattcaagtatcccctctgttgtttatttacgggaccaaataaacagattttaatctgtgaacaaattaaagtcctggcaccctgaaaattaaattgccaggaaaatcaaagctgtcaaaagagaagtctatgcaaaaatagtattgtttttaactctgcaggatccttttgaagaaaaaaaaaagttaaatggaggaaaacattaaatagattggtggtcattcttccagaacaagttaaaagccaaaagagaatactcagagctgagggacccaggaaagaatccttatctgggaagtgatctgggttcgaactccactcaccagctgcttgctaagaaacagactacttagactcctgagcttccgtttccacagggctccagttacaatcaaatgagtatctgggctggcacctgggcaaacagggcctggctcccctggccttaggctacctttcctgctctcctcacagctcctccctcccacacagccagtcctggaggatgacgatcctgcaaccaagctgaatgaatctgtatttggcttggctcacagcattaaaaaaaaatttaattagctattgccaacatttaaaaatcagaacaaatgtggagtgctgccttcctttttagagacagggtcttgctctgtcacccaggctggagcacagtggtgtgatcatagctcactgcaggctccaaatcctgggctcatgggatccttccacctcagcctcccaagcagctaggactacaggtggatgccaccacacctagctaatttcttaaaattttttgtagagacagatctcgctacgttgcccaggctggtcttgaactcctggcctgaagtgatcctcccacatcagcctcccaaagtgtcttgaaattactggcgtgagccatggcacccagccaaattccaccttcttctagaaaactgctgggtaaggttcctgttctttagggtccccacgactctgtgtccttacacctggccctccagactgattctcaactccacagtggcctacggtccttccttggccctgctccttcacacctctgtgcctctccctgcctagcaaatttcttatcaccctcaaggccccccagcaccacctgtcacctcctccacatttccatggcatagcccctcccctatagcaagggttgtacagtcctggaactaagtgtctgcatgcctgccttctctactgggctcctgggctctctcgggaaagggaccccgttgctatctgccttgtgtccgtagggtctagcagaaagcatgacctagataatgcagaattcagtaaatgtctcttgtatgtgtggaagaaagctacagctaaactattataaaaatgtgagattttatatcacagcttgttccaacagttagcaattaaaggggtcaaggacaccaaaatgtttcacaaaatagaacaagcttccatctgcttacaagtttcacacgctaatcagaagtcactaaatgaacagataaagcagagacaacaggcaggctgggccatttctttgatcattcattcattcattgagctgatactactgaatacttcctgtgtgctttctaagcactggggataaagcagtggacaaatcagacagctacctgttttcacaaagttacatcctagtcggggagacagaaaataagcaggcaaataaatagaatagtttcaaaccagatgagagctaggaaggaaattttttaaataatgaaatagcatgactaagggaagaaagagggtggtcgaggagggcctcacccaaaacgagacatctgaccagaggaaggagcagaaagagctacttgtgccaagatcacggagacaactccaaagacggggaaacagcaaatgcaaaggtcctggggcaaatgcgggctggcatgttcaaggcgggcgagatgagtgggacggggcagcagtcttctgggggaggggcgcggtggtaagggattcgggctgggtcccctctggcactgctggacaccgagtgtgcaatgacaaggcaagagaggagtgcgcggggaggcgggaggctgggcgggtggggagggggttcctacaccactcacaccagcacgggccagcaccctgcccagtcttccacagatgcacaccggggtcctgcccaggcgtctgcatacattcacacagcctgacaacaaccctgtccagaagagacatttccccaccttcccgaaggcaaaaccgcggcagagcgagggtcagtgccttggccaaggtcgcggggacgcgaccccgggcccctgggcacccggcgcaggagtgcagctgtctgccccacctccgggagggatggcgcccgcagaccccacgggcaggtcggccgggccaggccggtgagcaggcccgcagcccggggctgctgacagccgggcggaagggggcgcctgcggcatcccccagcacaggggcgacggctgcggctgccagggccccgcagcccccggcccgccccgaagcccccggccgcgcggttccctcaccgcccctccccgcgggcccggcccgagcagccgccgccaggcctagcccgcccgccgggctcacctcgcctccccgccgccgcgccacggggagagggcgggcgggcggactggcggcgctgcgtgctagtcactcctggctccgcggccccggctccgccgccggcccgccccgctccgctccgccccgccgccgccgccgccgccgccgccgcagtgggtgtgaggggcgccggggcgctgcgacccttccggtcccgctcccttctccgccgctgccgccgccgc

SEQ ID NO: 225 - DNA, 58477 bp, Homo sapiens; identical to SEQ ID NO: 224
  source 1..58477: mol_type = genomic DNA

SEQ ID NO: 226 - DNA, 58477 bp, Homo sapiens; identical to SEQ ID NO: 224
  source 1..58477: mol_type = genomic DNA

SEQ ID NO: 227 - DNA, 58477 bp, Homo sapiens; identical to SEQ ID NO: 224
  source 1..58477: mol_type = genomic DNA

SEQ ID NO: 228 - DNA, 46044 bp, Homo sapiens
  source 1..46044: mol_type = genomic DNA
tatagcaggaattttaattttacttactaaaatgcaccaaaaagtactcacatttttcatttttgtactttttgaagaaaacattttgtaataaaacaaggaatggcacaaaatgagtaagaattgagacaaactgaacattaagtagatatttctaaattattagtcttttaatttttcaacttttccctttttaattaagtttacttgcaaaataaagacgtccttatttataggttgcaacaagtgaatctgagatgaggctatggaaactgctagaaaatttagtagaacaaataaaataacttgacatattatataatctatgatatagaaaatgtaaagaaaggtaaataaaatgagagaaataaaaatattttcactttaagtttgcactgtgaagaatttataaggagaccactttgataaaattattaaaatctgaaattattttcctaagatacatacaaaacactgactatggagcttgatttccttaaaagcaaccatcaatctgcccaaggatggagaccaatttaaactttcataacgaaaacaaagtcaaagactaatgaaaaactaagtggttaaaacacaaatgaaaaagggaagatgtgaagaaccatgttagggtaaaaaatactgaggatggaagaatggcaaatgaggaaagaaggctattgtaacaattagagtagttattctcctttctgctgtatctctaacatgacttgctgactacagtatgagtttatctctttcattttacatttattttgacttccccagtgtgtcacaaaataacccactagacagatttttaaaaaaaattctacaaaatgtcagcacagtaacaaacaagaaagtttaacatattgttcctcacaaaattttcattttaatctctttcacttaggtcctttgtaatgtgcttcagttcttactttgggggaaaatatttcaatgcataccagtaactaacaaaatagtacttaattaaagcacacaagcacactagcctattaaatttagatagcatctttcctagttaaattaacggaataaactaaataatacagtattttcatttaaatatcagaatatacttatcaaagagtaaataatttcttctatgtgtccagctatttttggcaaaattaagagctaatataatcggtttaactgaactctaagtctcaaagtcatcacaggtagtcaagttaaaaataaagaatgaaattgaaccacttggcttgtgacactaattaacaaatacagtaaagccccccttagaacacagtctggagtggattttacgactttgtcctcgtgagcgctcgtgtaagcaggtggtcatgctgcctgaggcattaagaaagcatggcggggccaaggtcgcggggaaggatacggtcagtgccttggaatatcacacaacctttcaccagctctcccatgatgcaacccactgaccagatatcaactgaaaataaaatgaaatgataaaattatgaagtgccatgaacaaaacaaaagtgaggaaaaggaattctaacagtgcactaaacacacaaatatggaaaaataaattgctagctaagggtgacattttacacaatatgaatgattgctgacctctattttagccttcggtttgtagcaatctggggttttagtgccaaagagtccaatactttatagcttaaaacaaacaaacaaacaaacaaaaaaccagaaacaagaagtgcctgtgaacacaaagcttttcagggccacacgcccaccccagcctccatggccaagtaccgggtcccctgtgaaggatacagtctcttcccgggaacaggactttatggaggaccatttctgccatgatgcacccgacagaccagatgtccactaccaaacaccaggggattaaaaaccagctagagtcccccatcttttttcttcaaaccccctcccaggacaaacccggtacacgtcactagcttgccggcgggagcctctgtgcgttgttgataccacacctcctgagcgatcattttctagactgccccgtcagaaaggcagcagcactcactggcggcacaggctggctggcttgcaggactgcaggtgaggccctgctagaggggcccagacttccacggtgcccaccctcatctgtggggcctcagacagacagcagaggcctctaagtgccctgctggcgggccgaggggagaagtgaacaggggatcaagttttctctcccctccacaggaagcacatgaagctgtgcccctcagggtgggaacacaagctacaacgcagcaagatgaacctgtagcaaaactcatttcagatgacccgggcaaactttcagtctttttaaaaataagtaagcgtgatttcgttattttcaacaaatttgctaaaagccaagtttcaaagagctctgatattgctagaataagctaagttttgatgtaaaaagacaccaattttacatgaaaacatgtgttattctatttacatcaaattcaaaaaaacaatatgcagaccaacaaataaagctgatccatggtactggagatcaggagattggccagcctcgtgggctgcgaggaggggccatggggaggccagagctgctgctgctgtgggtgtgctcacctcagctgagctgcacactcaggatttgcacacttggctatagacagcttaactctgattaaaaagttcaaaaataacaattttaaaagtgaatttttaaaagagaatgattttaaccaatggaaaaacacaattaattatttcttatctctggatcatgctatattctgggtgtaacagtccccacagtatatatcatatggttcaaaggaaagagaaaaaactcgagaccaccgctagagcaatttctaaacatcccagcctcttccagccccggctatactcaccgttctctttgtagcccatacccaggatgacttcgggcgcccggtagtaccgtgtcaccacgtaaggggtcatcatgaagttagtgcacgctgtccgggccaggccaaagtcaaggatcttcagggtgcagtctgatttcacaacaatgttgctaggcttcaaatcctaggaaagaaatggcttaaattagtaaaatgaatgaagcatgctaaataaactacttcacatccgtgagggtcgtgaagccagtgtgagagtgtagggagtgaactgaactctgagatttgggaacaactttggaaaatcttactctcaaattgaaactaaaacaaatcagcctaaagccgtcagatggtgccccttacccccagtggaaaccttcatggcccccatttgccctttctgtggtctcgcaggccctcaggctgtcctatctaccctccatccatgcatctacacgtccagcacacatgcccccctcccgctctccacgcctggacttgagttccccaatactctgactctctcttgctaaggtcctcatgctgtcagtccagcacacacggccccctcctgctctccacgcctggacttgagttccccaatactctgactctctcttgctaaggtcctcatgctgtctgtcagtccagggcagtgctgtcccacagacaatgtcatataatgcgaacgatgtgtataatttacattttctactagccatgctcaacagcatgcagaaataggtgaaattaattttaatcatacagtatatttttttaacccaatatatccataatattatcatttcaaaatgtaatcaacataagaaaaatactgagatattttacattctctttttagtactgagcctttgaagtccagtatgtattttacaactgcagcacggccacatcctgagtgctccacagcctcctgtggttagtggctgccatactggacagcacaggtctagaatcgtctgatcctggaatcttcccatggctctttctctccttggaagagcaattccatgatcatccacctccaatcttctcaccttcgccacaaagacacgccagcactggtgctgctgtctccatctgtacgtggcacaaaaactcacctgctcatgttctggttgccacctctcttccctccccagtgctgactctgtgtgagctctcagcactcagaagcacgcctggcgcgagcagacacttgggaagtgtctgcagaatgaagacatgcatcatattccacctgacttgcaaagccttaacacaacttctgcaaccttttccctcataactaagggattttcttcctgctgatcctccaccctagccccttcctcaggccttaggaatttgacttttgcctggggacttcggcctgcaaactcacttgagaaactgtgacttgtaaacaacccacacccattcttttcacaagagtagtgcacctgcaatgtcaaactgccaagccactgacatggcgtaaggcatgaggatactttacccaggaagttgcaggttcagtagcactgcctagcacctgcctgtaagacaccccaactgatgggccacaaggggggttgcaggcggcatgcctcagtgaaggctgtggggctgtcatcagggcaagcaggaagccatttcgacattgacaacaggtacaattacactgccatgctgctaagtgacctgtttctaggcttcctagattctgtaagatttaaatgataaacatataatgtttaaaaatgcagtcacaatctctacctggccccaaaaagaggcccccagcccctccattccaccttagagtactgtgcagacacccccggttcccagaaaggcctgagaggaagaaaccgggctgcctccctgcatgaaggaaagccagggagaagcagcccacattcaaccagggacgctccgctgtgaggaccaagtcagggagctaagaccaaatgaacgaattcgcttcttgtttccttttttaaaatcaaagagtatgacaagaacaggcattttagaacataaattactaacagataaaataatgctcaatctcacaaaaatcttctttaaaaacccaaaatgaatgcccatttttagtctatcacttggcagcgatggaaagcaagcagactcggtgctggcgggagaagcagaaacaggcgcttcctcaggccacagagggtgtgcagtgggcactttctctccaggaggctgatttctgaggtgtgaaatgcacacacttccccagccagcaggccctgaagcccagcccacccagaactaacagcacggccgcaggagcaaggaagacaaggacagcctggttctaccaaggacagacgcagcagtggaaccatctccacgggctgcctgccagctctgtgaaccccagtgcgccagaaacacgctcatctgaagacactgccatctgtcaaaaaactgtcatcacatactaatttaacaggaaaagcacactttactgccgtctgctggaagactgtggtgataaagtcccaagcttgtgtgggtgctctgtgtggccaatggggaggtggctaaggaggtgctctccccgcaccctgggaccctctctagtcacccccgaaatacaacctgaggcagcttcccaacacctcacttcaatttcaagacagcagaggaaagacagttctgccccttcaagtcttgaaaatcactcagaacaaagaagacaaatgccaagtacagatccaagtgacgcctggatcggggcttggctcccaaaatgcctggaacccaacgctaccctgtgggcagcagtgagggtacccacagcacccgcagcatgagtggggcaggtgctgacctcccccactgcccgctcaactctgggatccagacccactgcttgagaggtatcccaggaaggagcacatcatgacaggtgtccactgtctggccttgccggtccttccccacaggtacctgtggccacccaccgggtaagaacagccaggcactcttgaggatgaatggacacagctctaagtagacactgaaacccgaagaccccaaacactctcagggctcctccacttgcagggttcgtggggtcaggggtcaggggtcagggcataagtgaagtctgggccaggtctcttgcggccatgttatgggagggtgggaacgttagcaaaggcttagagcaaggctgtgagagaacattgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgcggccaggactgccagtgccgtaagcctgtggccgtctggggtcattctccagaatccatgcagcttcttcaagggctggactaacgagttagactgggatgcaagataccactgtctctgctcccctgaggcttccatggtggccctagtctcctccacccaccccgggccctgcagggtgtgatcttgtttttgatttactatcttgggggcagtttcaggtttccatttggccttcccactgtgacgactcttactcacaggccaaggaactcgtgtgggcgttactccacctgccaagcgcctccgctccggctacacactgaggactggggagacggccactgggtggcctgggaccctgtggcccactgagagccaccagacacagacggctcaggaatgaaggcctgggacacaggccaggcaagccacagaggcctgccaatgtgagagctgagggtatgaataacaggaaagggtagggaaagagccagcagagagaccacagtgacagggactacagggtgtcccactaacctctgtcttccagatttcccctgaggaagagagaaccatgggcgccacaggaaagccattcccaacttatgtggagaagtagagctgagggggccagggtggactgtggggtccacggaaatgcactccttggtctcccgccacaggagtgagagtgacagatggcccagtgtggtgtctgcacctaccctctgtccctgccagggcacacctcccacagagccgtcagccaggggccgaccgggcagggatgctgaggcaggcccgttcctgtgtgacaccggaggccctcagagctgcaccgcagtctggaccaggcctctgaggggccaggactgcactacgttcagctagcatttgctgcctcctctggctgctcccccttccttctcgcacaggcctcctcccggccagtccctcgcctgtctaacccaccgtggcatgcggaagccgcccacgaaaagccccacgctacagggacaggaagctgcagggccgcccaaatgccctagctgagcgaaggaaatgccaacctctataaatggccacgacacccaggaaaggctcagcaagtgaaatgcaggtgctatggaggcagaagaggcaagggtagcacttggagaagttttcattttattgaaagtccaagtacgtagtagatgtcccagatccccatctccatcccagaagtgaggctccactccttcctcactcctgctggcccttcacgcagagaaactgatgcccagcttccaggtgcagggccacaggcgccgcatgcacagtcctgtgggtaccaacagggaaggcacggtgaggcctgcctgcaacagggctgcctggtgagtttgcgctctgccacatgagaagcacagccctgtaccccagcagccaggcttacatccctccaccaagggactgaaggggccttttccagagaaattaaatggtgcccagagaaaaaacctacagaaggtgacacctgtggctgcctgtggtccaagagacacccattctttaacaatttacccattcactcagtacttccagtcagcctttaatgcttcaatctcttttttttttttttttttttgagacgaagtctcgatcttgttgctcaggctggagtgcaatggcactatctcagctcactgcaacctccgcttcctgggttcaagaaattctcctgcctcagtctcctgactagctgggattataggcacctgccaccacgcccagctaatttttatatttttagtagagacagagtttcaccatgttgaccaggctggtgtcgaactcttgacctcaggtgatctgcccgcctcagtctcccaaagtgctgggattactggcatgagccaccgtgcttggcctaatgtttcaatcttaaacatgatccaaccagacatttggggaaagccttgcgtgtgacagggagggacctaacacactaaaaagggaactctcagtagagaaagacaatgcagggagtgataaaacccttcaacaaaagcttatcctcagagatgatagtatatacatgcaacaagaacagaatgctgtaaaaaggaacttttaagagcaaatgagtgtcaattaactcgtgcttcagagaaaaagaataaagaatggagttaagaggacattctgaaagaaatgatataaatttctcagacctctataatatgtgcttccagactgaaggccaagtgcccagcaaaactaaagaaaaaatgcccacatcaaggcatacatcaaaacatctcagaatacaaggaataaataactgagtttaaaagtttccagagataaaaccaaaccaaaacccaaaaccacagcacttaaaaaaggttagtcatcagccaggcacagtggctcatgcctgtaatccagcactttgggaggccgaggcgggcggatcacgaggtcaggagatcgagaccatcctgggtaacaaggtgaaaccctgtctctactaaaaatacaaaaaattagctgggcgtggtggcggacgcctgcagtcctagccactagggaggctgaggcaggagaatggcgtgaacccgagaggcagagtttgcactgagccaagaccatgccactgcactccagcctgggcgacagagcgagactccatctaaaaaaacatcagatggcactaagaaactccggagccatgctagatgccttgctaccacaggcactgcctccgccattctgagcgcaactgatctgtaactaagaattctacacacatctacacacaaccacactactcatcatgtgagagggcagaataaagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcaaaggggaacagggctgaggcttgggagaggttcctgagaagatgaaactgatgaaatacccaagacatctacatgtgctgagagaaaattcagatgcctgatggaagagttagggttgaattaccaccaagaacacagaaactaccccccaaaacaaacaaaaacctcacacaaatagagtataagtgtttgttaactccagggaacaaaaggtgaaaggggaaggtctgctgtgcaaagcatttacacgctcacgatgacgcaacgagccaaacaccatcacatccaccagcctgggaggagggcgaggaaggccgagggtgagggctgggttggtaagaagctaaatcagcatcttatgccccaaactgagaaaggatcaatgaagaaagagctaagcatattatttcaatatggaaatagagaccaaaataatcagctaaatgaactgaaggagtttgcttctagggagagagaaataaagggagaggtggaggtatctgtttttcataaatatttatagaaatatttgatccttgatttaaaaaaacaaaccaagctacctgtttaggaagttgctacgcagttatatgcaaggtgatcctgtctttgaaggatgtaagttcaaaaggacataagtacagatatgctggtgttaacatcagtcaacagagaggtgccatgcagagtgaggcaggacatgcaccagcgtgctctcactggccatctccaggtgctaacagagggctgggttacttgcatttcattttttgaattatataaagtatatacttcggtgggatatcatgggcaaaactttatctttcaaatacttaaaatttatgttttgtattaaaccattttaataggcaaaattaaaagtgtgtctatctctgtgcatggtactgtagatggaacaaaggatggtgcagtccacacagaacagttaacttagggctcctcccttcctgggatgtgggcaggggtggggcaggggggcagggggcaagagggagtttccccctttgctttatacacctgtgcaatgtttggaacttccccacagtgagcatgcatcactctcccacatggacacagatgtggggagagcctggcaaggccatggatgtgggaagcagcagggaacaaggtgacagggaggagaggacacagcaagatgccaggtgggtggggatggtgagcaggaggcagggatggcaacagggccattttctgaaggcttcttaggtttctatacctcgtgctgggcaaaccaaacactcctttgggccccatctgactcaggctgcaggcaccggctattccataaaaaaggcctgccgacgctgcagctctcacaaagcccccagtgacaggaggccattgtttcccacttaccttggggcccaagggggaacaagtcagacaaaccatttccccttataaaatgaataaggcctaatgtagtaagactaataatctgggaaattattctaaagcataaataaaatgtatttaagagatatcaagagtaccttaaattatatgaaggtctgtggaaacttcaggaacagaaatagaatggtacatcaggagatctttaattcagaagcctagtgttactatttttaaagcaaagtcaccaatatattattttaactgaccatctgatggcagcaaaggttctattttaaaaaacagtacactagatggcagatgggaggctgtcagctagccctgggaggacaagagctatccctgacgctgcccttgggccacagacctgaggcttgagacgagacaaccctgccctctgtgggtcggtgggctctacccccaagggaggccttcaatggctgtgatggaaccaatctttcctggcaaaagagatctgaaaaaattattaccactccaccatctaaaacccatctgcttatttctgtagtaacaggctctgctgttcttgtctctcactagcttcttccccacagatttcagttcagcaaaaagatgacctcttgctgttggaacataaaatctaatggcaatctgttgataaaattagtatagtaataatccagggaatgctaagaatatctatttccgataaaattatattatctctgcctctagtctcactcagtattttaattgttttttagaaaaaattcgggccaggaggccctaggtggctctgccacagactgtcaccctgtgaccttggagatccctaagcaggatgccatagaatcctggaagccaggaaatggaaacaaatgggaagaccagaacagtgaaagtcatttcaataattctggaaaaaatttatgaagtcctatgggagaaagactctgtgaatgtaaagaaggtagtcattgtggagaaatattcggccagattccaaatctgaacctgaagaagaaaatttctgctgatgtaaattcatgtgaatgcagagtgtgtggacaagtcttcacatgtccttcatcccttaataggcacatcttatctcattctggacacaaactacatgcatgggagaaacgtggggtgaagccatacaaatgtaaacaatgtgagaaaaccttcatttctctcacaaatgtccaaagacacatggtaacacacactggtaacaggcctcataaatgtaagaaatgtgggaagacatttaagtttctctatttacttcaaagacacaaagtaatttacaacggagaaaaaccctgtgaatggaagaaaggtggtaaagccttgagattttgcagttattttcaaaaacataaaagaactcacagtggggaaaaaccttataaatgtcagaaatgtgagaaagcctttggacattctggttaccttcataaccataaaggtgctcatgctgaagagaaaccccgtgaatgtaggaaatgtgggaaacgattcagtttttgtagttactttcaaagacataaagagctcacaatgtgaaaaatcttccatgtgtttaagaaatatggtaaaagactcactctttccagttccattcagaaacataaaagaaataatactggagagaaaccctataaatgtaagaaatgtagcaaagccttcagtcatccccgctccatgtgaagacatcaaagaacacatattggagagaaatcctataactgtaaaaaatgtggcaaagccttcagtcaacacagttcccttagaagacatgaaagaactcatactggagagaaacccaatgaatgtcaaaaatgggataaaggcttcagtcggttcagttacctccaaacacatgagagaactcatactggagagaaaccttatgaatataaaaaatgtggctgggcgcagtggctcacacctgtaatcccagcactttgggaggctgaggcaggcagatcatgaggtcagcagttcgagaccagcctggccaacatggtgaaatcctgtctctactaaaaaaaaaaaaaaaaaaaaaaatagccaaatttggtggcaggtgcctgtaatcccagctacttgggaggctgagacaggagaactgcttgaacctgggaggtggaggttgcagtgagccaagatcacaccactgcactccagcctgggcaacagagcaagactctgtttcaaaaaaaaaaaaaaaatgtggtaacaccttcaggcattccagctccctttgaacacatgaaaaatctcataccagagagaaaccctttgactgtaaggaatgtggtcaagtctttagacatttcagttctctaagtaaacatgaaagaactcacactggagaggcaccctttgactgtaaggaatgtggtcaagtctttagacattccagttctctatgtaaacatgaaagaactcacactggagaggaaccctttgactgtaaggaatgtggtcaagtcttcagacattccagttctctacgtaaacatgaaagaactcacactggagagaaaccctttgaccgtaagggatgtggtcaagtcttcagacattccaattctctatgtaaacatgaaaaatctcacactggagagaaaccctttgactgtaaggaatgtggtcaagtcttcagacattccagttctctatgtaaacacggaagaactcacactggagagaaaccctttgactgtaagggatgtggtcaagtcttcagacattccagttctctatgtaaacatgaaaaatttcacactggagagaaaccctttgactgtaaggaatgtggtcaagtctccagacattccagttctctaggtaaacatgaaaaatctcatactggagagaaaccctttgactataaggaatgtggtcaagtcttcagacttgcaatgtggtgaagtcttcagatattccagttctctatgtaaacatgaaagaactcaaactggagagaaaccctatgactgtaaggcatgtggcaaagcctttagatattccagtcctgtatgtaaacatgaaaaaactcatactctgtagaaatcctgagaatgtaaggatttggggaaaacattcagttaattcagttatctttgaaaacatgaaagaaattatactggaggaaaaccgtataatttacataacatgcatatgaggaatgtgatgatgcctttatatgttccagttacctctgagcacattaaaaagcacatggaactcttccatttccctttgaaaatacgaaacaaaactactactgaggaaaaattctatgcatgtaaacaatgtggtagtgtcttcagtctttccagttctacttgaagacataaaagaactcatttctaaaaaaccctataaatgtaaagaacgtggggatgcctttgtttctctccggcacattgaaagacatgatgtatgcaaactggagatggatctttaaatacaagaaggtattctgtatctaaaccctagtagtttgcaaataaattttcattttaataattatttcaaaagtcatctgagaactcccactgagaacaaatcttataaatttaaggaatttggaaagcctgatgcaaattaaatattccacaatgctcaaaacatgcacatgaatgaaatgttatacaagttataaatatattgtgtttgtcagtggctcatttctaatgaccatctctggactgttgatttccaccttatttaacacgaaaatattgaggtgagaattctgtagataccctttaagcaacatgaatccaataggtagtgtgggtttttttgtcagttaatacaaaattttgtctgtatgtctaaatgtttttggatctacaggtgaattaaaatgtatttctaataagtaggtaacactgatttttatgtagctttttaattgttctgtaatatgtcattgaaaacagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaaatctatcatgatagtctgcttacacagccgtacaagtaataataacaaaaaattgtaaaatcagcttagagagaattatattaattatattatcgctccctagcttattaaatgtttttcctgacagtacagtcacactgttattcaaatcccggcctctgctgagcccacaggcctgctctgaacccttgcggtgcagggtctggccactcccaccagtgatgcagggaagctggcacggcagaattttaggataagagaaatggatatgtgggtcattatttaagaaagagagttctcaagcagctgtctcactgactacttggcctttaagttccttgctcattaaaaatgggatttcacatatggcaaatatattaaaaacaggtgaatgtagataaatggtagttggaagttctctgtcctattcttgaaatttttctctaagttttaagttactttaaaatgaaaagtttaaaacaatgtattcttgcgcagtatctgactgagagcgcagtacctggctgtgtccacagcagctggtctagcctggcaggccaggcggctccacagatgcctcctagaatgactctcttaaaacaccatatgattccatcatctatttggattttcaagcctaacaattttttttaaatgttattttgtatgtaaaggattatgacaaccaaatgattgtttttaaaaataaaattaatacatcaccacttactctatgaattataccagctgaatgcagatgtttaataccacaaagcatctggtaaagaaggtaggacattctttcatgatccagctccatgtgaataacctgacataagttagcatccattaattccataaccaaatacctgagggagaaaaggtcagttatttatttgaaaattatccaaagttcctttatgactaaatttcatgaaactgtaacttacttccaatcactgcactggctaaagtaaaaagataacttggtataatggaactttctaaaaattttccaaagaatatataaataacaaacttaacgtcttacaagttaaaaattaaaaaaaaaaacaacaaccttttatagcatggtaaatagaatctcaaacacaaattttcctacttcttacatttttggctgaaattctccgtaccagcctaaagaccatgctgttacaggctcatcaatcacaacacatgtaccctctggtgggagatgctgagaacgggggaggctctgcacgtaaggggctggagacagacaggaactcagtacctcccgctcaattttgctgtggctctaaattgctctacaatatatacgtttttaaaagtgattatacaacaacaacaaaaaggacacttgaccccactccccgcttagcaacgccccgattctttgctccctttgcaagcaaaactccccaaagaggtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaacagccatcatgcctggatagtttttgtatttttagtagagacggggttttgccatgttgcccaggctggtctcgaactcctgacctcaagtgatccgcccacctcgggccttccaaagtgttgggattacaggcatgagccactgcactcagccttctcccatttttttcttaatcccacttggatcaggtttgtgcagccaccattctgctgaaactgtcctcctcgaggccactgatgtcttccatgctgctaaatccactggccagtcctataatcccagcgggccctgccctgtcctgtctctaacttctcgctgtcaaaatacccagcaactggtccttgaccctcttctcttctgtaaccacactcactttcttagtgatctcagttacaggccatcagctcccaaattcctacgttcaattcagacatatctcctgaactccaggctcattcctctgcctccctattcccagttccaccttgatgtctaacaggcatcttaaagccatctccagaactgaactcctgattccatccctagcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccctctcacccttcctattacccctctgggccaaatggaccctccgtcatcccttaacagaactgctgcaacagcagtaactgatgttccatgcccccaccccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcaccaaattctttttttttttttttttgagacagagtcttgctctgtcgccctggctggagtgcagtggtgcgatcttggctcactgcaagctccacctcccgggttcacaccattctcctgcctcagcctcctgagtagctgggactacaggcccccgccaccacgcccggctgattttttgtatttttagtagagacggggtttcaccgtgttagccaggatggtctcgatctcctgacctcgtgatccgcccgcctcggcctcccaaagtgctgggattataggcgtgagccaccgcacccggccagaccaacttctttatccccttcaaggctttcttcgaatgtcaccaactcatggaggtctttccccagccaccttatttaaaactgcagcctcaagtccaaccctcagcacttttgatcccctgacccagctccaccctttgtccacagcacctagcacattctaatggactacatgctttcctcatttatcatgtggcttgtctatcttccctgacaggctccagggaagccaggtaggccaagtcccagagagtgcccagcacacagagggcaatcagatatttgttaatgactgaacacaccaataaattcaggatgaagttgggcattatgcctctcaatagattaatacttcatttcactgttagtaagatgattctacttaagattctggaaatacagaatcttaaatagaattagtgacttaatcattttaagtaatactcataaactcctgaaccctaaaatcctggctatcagggatttgagaaaaacattttatagttcagcaaaacacattagtgatcctggtctgctctgaagaattctttccagtcatcctttatctgttatgaagatgaaaacccatgtggtacaaataattaaatataactatcaaattttctaaatatttctctgcaacagagaaagttatctgtgatgtcacaaaatgtattgccacctacatttcctaagtataaaaagcagttgctgtcttttctagatgttcattctttgatgtacagtgcattactgaataaaaatgatacttacacatcttgaaattcttctagagttttttgtggtgtaaacacatttaacaaactaattatctgaaaagagaaaattaattatacttcaatatgtcagattacttgattacaaaaattaagtttaatattgaaatgcattaagacgggaaaaaaatcacagcagaattcagtacttcttattattactgcttttaccaattacatggcatttgagaaaagttaaacatcaattaaaggaaagatgcacttttaatcaaatcacttttatgtgtccctagtaacttaattattacagaatttaaacacataatgtctttttgaacataaaaaagtagaatttacaggtaaaaagacattaaagcagtatgttaactctgaaaacttaaatactacgcacaaatttctaaaaaggtttgaaatatgaaggctaagctcttgtttttggtgtgataaagtgaaaggcctcgtagcatcatatttttacctaaagagggttaaagagctgatcctgcggcaggcctccatcctggcaccctgacatgatttggctgtgtccccacccaaatctcatcttgaattgtaatccccataatccccacgtgtctagggagagacctggtgggaggtgactggatcatgggggcggtttcccccgtgctgttcttgtgacagtgagtgagttctcaggagacctgatggttttctaaggagcactgcccactttgctctttacttttctctctcctgccgccttgtgaagaaggtgcctgcctccctttcgtcttccgccatgattgcaagtttcctgaggtctcccacatcatgcgcaactatgagttatttaaaccgctttcctttataagttacactgtcttgggtatctctttatggcagtgcgggaacgaaccagtacacagcccatggtgtaaacagcgagtcccacggcttaggcaccaaacacataacctcagtcattccagatgactgagggaaagatgaattatccattatacaggattggggtgattggttagctaaggacaaaaataaaactgcatccatatttcaatctttataccaagaaaaactctaaatggaacaaagacttaaatctaaaacatgaaataaaacctcagaatatagataaacatttatataatcctagcgtagaaaatcttttctaaacatgacaggaaacctaagagatctgattacattaaaatgaaacaaaaaatgggtgataaaaaatcagtatgtcaacaacataaataatgtcaaatggaaaaaaaaaagtaaagggcaatagttttaatatttaaaaaaaaaaccctcctacaaatgcagaagagaccagcagtccaaaagaaaaatggataaaggccataaaaattaaattaccaaaacacataaaaataagtaacaacctcaccaataaaaataaaatatcatttatttatcaaattggcaaaagcaaaacaaaaaaaatcaacagtatgtagtgctgggggattctgaagtaacagacgttctcagacactttttttttttttttgagatggagtttcattcttgtcccccaggctggagtgcaatggcgcaatcttggcttactgcaacctatgcttcctgggttcaagtgattctcctgcctcagcctcccaatgagctgggattacaggcgcccaccactacgcccagctaatttttgtatttttagtagagacggggtttcaccacgctggccaaccaacgtggtcttaaactcatgactcaggtgatccacctgccttggcctcccaaagtgttgggattacaggtgtgagccacagcgcccggctgatacttttttttttttaggagatggggtcttgttttgttgcccaggtgtgccttaaactcctggcttcaagcgaccctcctgcctcagcccaagtagctgggattacaggtgaagtgaccgtgcccagcttctcaaatactcttaatgaaaatatcaaactaatagtcttccttgaggtcaatttgtcagtatattttaaactagaagtgtgtgtactctgacctgacaatgttggccaagaaattcacctggacgagtatgcaaaaattcaggcgttagaatgttcattgcagcactgcttataacagtgagaaacaaaacaatctatccaacaacaggcggctggcagtctcttaaataaattactgtgcatctgtgctatgcaaccatttaaaaactggctcatatctatgttcattaaagtatatgaggtctaccaacattgcacgaggagaaaagcaggatgaagaataacacgattaatcttgtttatgtacttgtgcacatgtatgcataagaatgctcaccaaactgttaatgctagtaatctgtgggtggcggtattcaggagtttttacttttttatattgtttgaatttttaaaaataatatatattttttgtaacctgaaaaaattttttaaataagtaagtaaaacaagtccgggtgcggtggctcacgcctgtaatcccagcactttgggacgccgaggcaggcagatcacgaggtcaggagatcgagaccatcctggctaacatggtgaaacccctgtctctactaaaaatacaaaaaattagctgggtgtggtggcgggcacctgtagtcccggctactcgggaggctgaggcaggagaatggcgtgaacctgggaggcggagcttgcagtgagctgagatcgcgccactgccctccaggttgggcgacagagcgagactccgtctcaaaaaaaaaaaaaaaaaaaagaaaaagtaaaataaagcatgcattagagaaatttaaaccaactcaagccacagactcaaaagaaggaagctcaggagtttaagatcagcctagacaaggtggtaagaccccacctctacaaacaattttaaaaactgccaagcatggtggcgcacgcctatggtcccagctacttggagggctgaggtgggagaatcacaacctgggtgacagaatgagaccctgtctcaaaaaaacaaaacaaaaaaaaccagatttcacgttttatattttatttatttatttatttatttattttgagacggagtctcgctctgtcgcccaggctggagtgcagtggtgctatctcagctcactgcaagctctgcctcccgggttcatgccattctcccacctcaccctccttaattttttgtactttttagtagagatggggtttcaccatgttagccaggatggtctctatctcctgacgtcatgatccacccgcctcggcctcctaaagtgctgggattacaggcgtgagccactgcacccggccaacattttgtaattttataacatggcaacgttatcaacataatgctcagcgaccactaggagaacaaacaatgtgcttgattgaacccaacttcattttctagaaacattatttctccgtaaaatttagtgctttgatttctgtggagcttccaagaatagctactctaaatgtaacatcatctaataacgtgtatttgaaactggtgtgtcatatacaaggtaaaaacctacttatagaacaacatctttccacaaaatatttagttgtttctcaatttgttagatcaatactgttcctattttatagaaacagagtatcaattgatattcctactttggttaagtgacctaaattcctatgcaccataatgatgcctctttctagctttgatttcctcaatgtttattaagaattttatcagccgggcgccatggctcacgcctgtaatcccagcactttgggaggctgaggctggcggaccatgaggtcaggagatcgagaccatcccggctaacgcggtgaaaccctgtctctcctaaaaatacaaaaaattagccgggcgtggtggcgggcgcctgtagtcccagctactcaggaggctgaggcaggaaaatggcatgaacccgggaggtggagcttgcagcgagccaagatcccaccactgcactccagcctgggcgacagagcgagactccgtctccaaaaaaaaagaatgttatcaataaaaaataggccgggcatggtggctcacgcctgtaatcccagcactttggaaggccaaggcaggtggatcatggggccaggagatcaagaccatcctgactaacatggtgaaaccccatctctactaaaaatacaaaaaattagccgggcgtggtggcaggcgcctgtagtcccagctacttgggaggctgaggtaagagaatggcatgaacccgggaggtggagcttgcagagagccgagactgcgccactgcattccagcctgggcgacaaaaaaacaaaaaaacaaaaaacaaaaaaccaatgttaatagccatttttatccttagcttatcctaggtctgaactcaatgtatctccagaaaaccctgaagattaccacattattgacaatatggaagcacacagacaaaatacatacataacttacatttttatgattgacacattttaagaggacaagttcacgataagctctctttgcatgagtttggttctgaaaaggacggcttagtttcttgactgcaacatttatcccaagaactgtatcaaatgcagcactagaattaggaaatataatgcacaatccattagaacggttttggaaaatacagcaatgccagaatatacattgaatatatcatctttttaataagtaacaaggaaaaatctgcttatttcattcaaggtacttgcacatatgaagagcagagtgagttgtctaagactacagcatgtactaactcctttgcagaggcacatttcagccacagttaagatggggttcagcaatccttcacacaccaaggtttcatagtttagattacattcaaaaccaggtaatttaatatagagtgcataaaaccagtcaagaaatgaaatcttcagtttaaacatgacaagaagttggaaacaaagtcactgtttcctgtcttaaaatgtgtatattttggaatatcacagtagaggaaatggctgaattcatgaggagaataaatctaaattttgaatcactgtgtttttttcacaaataacagtatctaaaaagaaaagaagccaaaatttcagctcatggtaaatgttcaagatacaaaatctctaacgtaagcaactgctatataaagttcttttagaactatctcctcctactactatagtaagaataaaatctacaggctgtgtttccagcatctcgtttcctgttgaaattctgttcattttcctccagaaaatagacatgaagaatcaagtagcctgattacacatttttaggtttcaaactggtactaaatagtatcatttgtattatcacctctgggctactcatgagggctaacagctactaaaggccacctgagaacctaagcactgatttaaatactgtttctatttctttattccattgagtttataacattgtttacatttattctcttctattaatgcttttgccaaactcgaacctaattcaatctgttttaaagttgaaggctatctgttgtagcatttggttaagaagctaccttactttaattcagttcatattatgtgtctgtctatatacatatgtaaatccacaggttcatatgcaaattgcaccatttatatgaattataaaatgagaaggatatatccacttgtgaaacaagtcattgacatacatgtagccatgtatgtatttatacctatatacttctcagactcaagaatttgaaaataggccaggtgtggtggcttatgcctgtattcccagcactttgggaggccaaggcaggcagatcgcttgagcccaggagtttgagaccagcctgggcaatacagtgaaaccttgtctgtacaaaaaatacaaagattagctgagtgtggtggtgcatgtctgtagacccagttactcaggggactgaggtgggaggactgcttgagccgggggtcgagactgcagtgagcactgatccctccactgcaccccagcctgggtgacagactgagaccctgttgcccagggtctcaaaaaaaaaaaaaaagaaaaagaaaaagaaaaaaagaatttgaaaacagacacacttttttggtatcaaaagtttttgtccaaaatttcagttagataggaggaataaggtcaggaggtctactgtgagatatggtgactgcagttaataacaatgtattgtattcttgaaaattgatgagagtagatttgttctcatcagaaacttttaaaaagtatgtgaggtaatgcatatgttaattcgctcaatttagctagtccataatgtatacatatttcagaacaatatgctggacatgataaatatatacaatttttatttgtcattttaaaaaagtttttggctaaaacaaggcaaatggaccaagtctaagcatctaagtgggcataagcttccccacttgtagctcagctccatgaggaactaccttcagttattcctggttgtggttattgcggtcactcaaagaatacattgttatcactatctcttcatttatcagctttagaaatgattcacctactccccattacgaaaactgagtatttggccacttccttgaaatccccaatcgccaacacctcctattttttttgttgttctgctttttgggttttccctggttacgtctttaagtaacacccctaatcttcacgcttcttcaactctgaagggaacgtcttgacttctgcttacgtaaaatgagactgttccatccctttctcctccatttaccatatattcataactaagtcttctgtatttcttctttaggatgtttctagaagttgaaaatcaatacatggagtgtaggtgtgtatgtgtacaatgtaaatatcactaacggccagagttgggattacatttcattttctaaagatcacatggctcttgctgccactcataagagggtgagactatttccaggatcaaggacaaaggattctcttatatttcatcaactgctcaaacatcatgtcctctttgtttcataattagaccatgattttttctagttttccccacacatttctaataaataatagattttattacattctagattattattagtttttactaataaaaaatgccagttttagcctatcattgacacatcttagcttctcacattatctgttgtgtggcacctactccacatgatttgcagacactctttagcctatcactggcacttcctagcttcttacattattgttgtctggcatctcctccacatgatttgcagacactcttcttgcagcttccttaagacctgccatgcagccaccatcctgggatttcttttcacagtccccactgcttcttgcattacgctcttgtgttgcctctcttgctggagtacatcctcaaggaatttcctcagaaaaggtgcatggaagatagatggtattgctctgcccccacccttgattgataataagttttctgagtttaaaatcaattttctgtgagaactttgaaggcacttttccactgatttccacactgagtgctgacagtgaggaggcttatgcccgatactgtactgattcctttgcttctttttttgtttcccagctcaatgatttatcagtcatgttctctctgtatcccaaaagcttctcacacccccaactaattagtgtccctcctgtccaccagtgataactgctttgacatgtacaataatcactttcttgctttaccagctaaagcatgcaccctggagctcccagtttatttttgcctgttttttgaaatcttctgtgtctgacttctgtggctcaatattatgggactcatccattgttgctgtatgtagctataactccttccatcattgctataagattcctttgtataactatatcacattacgttgatagatatttcagttgtttttagttttcaatctattacagaacacacagtcatcaccattcctgtacgcagctccggatcccctatgcatgtgtttctgatgagtagacaactaagagtgggaacgtatccattgtatttcagtagataatgtcaaactctttgccagagcgtttctacaaatttgtacagctgccagcagtgcacgaggggtcacatctgagagctgcctctgcgtggttccagtacacgaggggtcacatctgagagctgcctctgggtggttccacatcctcaccagcacttggtatcaccaacagcttagtttctaaccattctgctgagtgtggaatggtatttcgtcgcagttttaaattgcactatcttgatgaataacggcattgagcacttttcctgtttataggttatttgggtatcctcctgtgacaacctattgactatttgtttgtctatctttataatcttcttgactgttgttctttacatattctgaacaagagattttttttcagtcatatatcttctcacatctatgcttatcttttcagtttcttgatcttggttttttaaaataaacaacatttcttaattttaatacaaaattgatcaatcttctatgataatttttttttttcttaaagtggagatggggggagtctcattatgttggccaggctggtcttgaactcctggcctcaagcgatcctcccaccttggcctcccaaagtgctggaattataggcatgagccaccacatccagcagataaatgtttttttatgttgtgtttaaaggagtccttccctaccccaaagatcatgaagacattctcctatattatgttcaaatagctttactggcttgccttatatatttacagcaattcaactgacattcacttttgtgtataatatgaggttggggtcaaatttcacttttttctacatgaacattcctatgtccatttatttaaaaggctagcctttcctcattgctccacaggccaccactgccataagtcagaagcccacacatgcatgactctgtttcagggctagtccactgtttctccttgcaccacacgacaccagcttgatcaccagttttatggtaagtcttcacatctcgcagagggagtgttcctcccttcttaatgggtgtcttgaccattctagggtttttatttttacatataaattttaaaatcagtttgttcatttctttgttttttaagacgactgagatttgattgcaatcactctagacaagtctgaaaaatgaccttcatggtattaaatattctaactctgaaaatcagacatcccaccacgatttcagttttctctattttttctaatttttttagctttttgtatacaagtctttcatattgttagatttttcctccagatatgataatttaaaagtttttatcctattttaagtggtatccttttcaaattttcattttctatatgctgctagtatataaatatgcaattttgcagggggaggggtacatatactgaccctgcatcttgcaaaagggctaaacgtactcattaatttaacaaaacgcagattatccaggtgggcctattcttatcacgagagccctttaaaggcagagtttgctctggctcatggaaagggtggaaaatcagggagatgtgagtatgggaaggactgggcatgccactgctgccttgaagatggaggaggtcacttgagaaggaaaacatgcagcctctgggagcagacagcagcgcctgactgaaagagatcaagagattgggaaccacagacctaaagctgtaaggaactagactctgccaacaggctgaaggagcttggaagcagatacccttccagaacctccatctgtgagctgagcccagcccagtcgaaatcttgacttcagctttgtgagatgctgggcaaagaacccaggcaaacccacccaggtttctgactatagaactatgagataatcaataggtgttgttttaaacaactaagtttgtgttaatgtgttatgcagcaatagaaaactaacaccttctctgttttgggctcttctaccatttttgcctctgcagctttcattctggatactttttgctgacctctcctccaggtcactaaatctctcttcagttatatctagcatgctgttacacatattaaattcataattcaattactatagtttttacttctagaattttgatttattcctcttaaaagaagttttcatttctccaccaaaacttttaatcttgcctttatcaccttgaacgtaatatcatagctatttaaaaatgtggatctaataatgccaatatctcctatggatctgtttcttttgtctgctgtttctgcaggattttattcatgttgtcatatctccttgtgtgcctagactgggccttgcacgtataaaactgtttgctatctagaaataattttatctaatatgatgctgtcttcttccacaaagaatttaaatttatttctactaggtacctgggggcactagcaatttttgtttacccccatacaagttcagcaaatgagatgataatctgaagctgagtggcagtgcctataagggccaatctctgagttacctttacttctaggaagcagccttttattggtcccaacacaagtaaaagaagtttgccacacaatattagagggccctggactctcatccctgtctcctagccacagggcagtccaaaacactctctcaacagccccttccagaattttcaaatgcccccaagggaaagacagccccacatgctgaagctcccctcactaggcttctgtgcttccccagatcctgacctagtaactcctcactaacttactagctctctaggggaaaatgctgagcatgggggacagtgggaatgttggcagaaaactggcacagctgtttcacaggcacacttttaattaacagccctagttttagccactcatttcatctcttcttcattgtcatctctatgcccacagcctctgtagttttactatagctaggttctcttccttacgcacatacttcagctgcttattctcactttatctgctgttttatctgtatcacaagattcaagctactttctatatttcataaatttgttaaaactgtcttccacttattactgccctcttatctttgtacaggtgttcgggccaccatcttaaatgagaagttccaaaccactcattttacaggtgaaaatattgaggcccataaagaaactgatttgccctgctcacaaagaactcttcgctgaggaaaagagctggactcagaactcaagtcttctgaatcacagccatcctgtgcctcaaaccatgtctcctttatcacagaaattttgttgtgaacattgttatgtttttatttatttatattaatagaaaataaaccatgttaagaacaggccagtactcatgtttatacagaacttgaggacacaaaaaggaacacgctataccaattatttcatgttaaggctgtaactgttacttctaagaaccgccagactcaatattgaacacttttttaaaggttaagcatttcatagaatggtttcgtaaagcaaataatctttactattttggccaaacttgagatttttgaaggagaaagaaaaactgaatatatgtatgaaagaaatgtacatacattttctccactagagcttcaaaatcttacaattatttaattgtactataacacagttgatatttatgaatacttcaaaattatattttaaaacttattttaggccaggcgcggtggctcatgcctgcaatcccagcactttgggaggccaaggtgggcagatcacgagatcaagagatggagaccatcctggccaacatggtgaaaccccatctctactaaaatacaaaaaattagctgggcgtggtggcgcacacctgtaatcccagctactcgggaggctgaggcaggagaatcacttgaacccgcgaggcggaggttgcggtgagccaagatcacgccactgcactccacctggtgacagagcaagactccgtctcaaaaataaaataaaatattttaaaatttaaaaacttatttcctaataaattttactaacatatttaaaggaacaaaaacaaataaacaaatcaaagacaactataaaaacaattcaaaattaggaaccagaatattttcttctggctccagctcttccatttaatcctgtacaggtcacaggccctacctgcacgttggtttatctgcacacctgcccttcataaagctctaatttaaatagaagattaactagttgcataaaccatacactgttgctgttatatttctcaaaaatgtagaaatacacatgcttgtgaattagtttcctattgctattgtaacaagtaaccaccaatttactgctttaaagccacacaaacttactatcttacagttctggaggtgagaagtccaaaatgcatcttatgcctcaagaggtaagcagggctgcgtggctccttctgcaggctctggggggagtctgctccctgcctctctcagctggttggaggcttcctgtattgcttggctgtggccccacatcactccaaacttcgctctgccatcacatctctgactatgaccttcctgtctcccttttgtaagaaggacccacccaactaaacctgggataaccctcccatctcaagaccattaatgtaatcacaccggctaaattccttttgccatgtaaagaaatatacaaattccagggattaggacgtggacatctcaggcgggaccattattctgcatgctacactccccaaagaatcactgacagatgattttcaagtacaatagtgatgaaaggaagtttcagatcatcaattaactacataatgccaatattttaatacgaaatatgatagaaaatccaattcctcttgtcagtgttagctaatctactgttgagcttatttttggaaaagcaagcttttttttcttttttgaaacgggaatgtgccgtaactagattatttcccaattctacttggtgcctcatagcctggtgaaggatacagagaaaagagaaaggtgaaaaggaagcgaaaatcacttataaagtgtttactttccctattagaacataagatagaaggataccataaaactgaaagtcagttatagctataaaaattgaaactgttcttgaatgtaacaattgtcttatagagataaatacaattaaatgaaaattgtttaataggtgtttagtgaatatttgttcattattactaagattctaaacagaaggtgggtcagaggccttgacctatcaaagtatcagtggttcaaagtcttcaacaagtctctccgtggtacaggcaataaggtcccaaaggcccacagcttgttttggtcccaggcctaccactaacaccccgtgagacgggagaagcaagtgagccttcctagtccttcgattcaccaccagtgagggttatggcagagctcatggtgattctacaatatacactattcacattactaccaaccttcaaaagcaagtgaatgacatgccagctgggataaatgaagcacgtatttaaaacagctacctgtaggccgggcgcagtggctcatgcctgtaatcccagcactttgggaggccaaggtgggtggatcatgaggtcaagagatcgagaccatcctggccaacatggggaaaccctgtctctactaaaaatacaaaaattagctgggtgtggtggcgtgcgcctgtagtcccagctaccgggaggctgaggcaggagaactgcttgaacccaggaggcggaggctacagtgagctgagatcgcgccactgcactccagcctggtgacaaagtgagactctgtctcaaaaaaataaataaataaataaaacagctacctgtctatagccacaaacaactccccaagacctccgacatttctcccttcttgccccctctctcctttttctctctctctctcgcatgcacacatcaaattatctgtcaaattatcatctaattccaaataggagatgggttataaaccaaaagaatgctttgttgtttataactttccattaccatcaaagtttcctaatttgaaccatcctccactaactttaaaacttttttttttttttttttgagacggagtcttgctccatcgcccaggctggagtgcagtggcgcgatcttggctcactgcaacctccatctcccaggttcaagcgattctcttgcctcagcctcccgagtagctgggactacgggtgtgtgccaccacacctggctaatttctgtatttttagcaaagacggggtttcaccatgttggccaggatggtctcgatctcttgacctcgtgatctgcccagcttggcctcccaaagtgctgggattacaggcgtgagccaccgtgcccggccacctttaacacttcttctggcacactggatttaagtgccgatacagcatgtgtcatcaggaagttaagatcaccattactttagatgcaagctgggcattccttccaaacagtccctttcccgccttagcttctcaaagaagctctggactgcaatttcctcttagctcccagggccttcagccgccagggctgaaaaaaacaactgtttccctgatcataggtctccgcaacaaaggatcagttaaaaatcatcgttaaagattctccaaacccaacatctctacaaggaaatgtaaactaccctactagagcatcgaaaagagctttcttctccctcaaccccctctgcctaccagctgtaaacacgcgatgtttaactgcaccacggtttctttaggcgcaaaggtaatcctgttttcattgaccaaaaaaaaagaaaaagaaaaagaaaaaaaaaagttctgcccagaaaaataaggggtaaaaagtgtgggaagtgctgatagctgcagtctaggaaacatgtgaagagctttaccttgagctggcccgtgatgctgcggcggctgaccgtcttaccatgcaagagactaacgttcagggtcagactaacgattctgacgttctgggctggacacacagttgaagtgagacaccaaggaagagatggccagcccaacccctcacacagcatcccttcctggttaatccatggagtgacaatgacactgactggcctcatcctgccaatgaatggcaaggcactgcaatgatggcgcctggaaatgaacaggagtgatcgggaataaaaggggaggggggaaaaggtggccatgatgaagaaatgaataaaactccaaatttctgttacaactcactgtcatacctactactctgatatcataatgacaggagaaatgaaaaaaaaaatgaaaggaaaaagaaacaaacaaaaaagaaaacttgctacctatttaaattcctgcagcattctaagaatatgggtttgtaccctacagcctgactacacagaactagagcaagcagttgattcaatttagctcataaacctataacagagttttttttttaatcatcaatgtttctaaatcctgacactttagttttactttttattacagcaaaaactcaatccacgctattaaaacagaccatacttaccaaacaatcccttgggccccagagccaattggtttcagctgctggtaacgttttaggacagtgaaggttgagtctgccacttgcacactataaaactgactgtcacatttactgtcgctcatgatgcagcgtcctgcaatatcccgaagggtgggcaagtttcagatcccttcaaagaaaaacagaatgaacgtgcattcttaccggaagtacatacgcagctcacgtaagagagttctgaacttattggtatgtaagacaatgtggctgtaagttgataaagtcaatctgaccaagttctgaacttaagcaagacacaaaaaaatgcagacatttcagtggtaccagaccattatgaaaggaaggaattttgaggcccagcaagaccacactttaaggggctggactagaaaataaccacctttggagaaaagaatgtatgcattactactggctatgaaaagactacatcactctgtgcgtctcatcagcttgccccctgtgggcaagctaggtgtaaatggttcatttacacctagctgtctagagacggaggcattgtttcaaaaatgatcacttctagaatgcctaaagagaagcaaacggaccagtcttctgctcagtgtatagattctggttgaaatgatgaaccaaaaagcaagattcatacgccaaagtgacaggctgtcagaggcctggtggcatcagtgtgctgcatgtgcccaagcacgtgctcctgcctcaggaggtgggtcccagagctggcatcagctggcacagccccagagtcccacatcaccaccggacttcagggtagagatctgtatatgaagaactctgctgtgactgacagtccatcatagtaacactaggaagtctatccactatgtctgagtgtaggccagcaggcccagaaagcagcttttctgtggttgaggcacaggctgagactgctgctctgcaggagcctggatgattttatacagaaaacaagcaaacaaattggcaagtggttcctaggctcgtgtctggttatgcttatttaaaagtcagcaagctatttattttggtcttttaaaactacatagccaacaataaaatcatataggtaaacattctataccgtttaagactacagaatgtattctacagctctgtcaaatcccttgcctttatgttctagtatctaatatttaacgtcaacctaatgagatttttgtggtgatgatttatatttcaacacaaatgctaggattttccttaaacatggaaaaaatggattaataacaagtctaaataaagaactgagtcaaattaataatttctccaagtgaccactgccccacggtcttctccccgtcctctgggtggtggctgcagtgtggctgccactctgaccactcctgccgaggtgtgttagcgtgccagccagggagtgactccagtgacgccacagcgcttagatgctggacaaacagctgctcatacaacccgcaccgcaggagtctcagtcccgtgttacctgggagcaatctagggctgagtgagctggaacacctgcctagcccacactgctgtgagaaggggactcaggagctctccaggctggcaggtcactgtgctctaagctataggaggtgcgaggcaggtctgtcttgctcatggcatctcatactccaaggacaggaggacaggaagctggtctttggggcactgtgagcattcaataaacctttgttgatctgattccccacagtgctgctccattttactgatatctaaaggaagatcctttctaaagattagcttatttacagtttgcaagaggctgaaacaattccactcaacatttagggggtacctttatgcacgaaagtggtaagtatagcaaaagatatgccatagtcagctagcaaccagtcttgaaacaacatgtacttcactatttgggggagaagcgcgagcagtgagtccattatctatattacaagtcacagtgcggtaagggccataagcacaatgtaaacaaaatcaaaaggcaaaagagatcctacccactggcaggggcagaagacaaggacggcttcaaggaggaggcggcatccgccctcagactcttttgccagagatggacagtagagccacagagctcaaactgactgtgtccagacacagcgaactgctgagcttggctagcggggtacaagtgcaaaggattagagacaactcagcaaaaaggcaggcacccactaccacctgctttacggagggtggctgttcctctgctatgccgtcaacacaccagcaacacagttacttgcaagcatgtactgagcacccgctgtggatggtgaggtaccatgccaggacactcgcctgccctcagtgagcgcacactcaggaggaggccctgcacaccaagggtcctaaacccagtagggtgaagaagatttgggggaatgggaggagaagcagcagaggcggaggcacattcggaatgtgacaagtcactagggacttgctgggtagagggcgagtgaagctggagagagaaaaggaggccagatcactatgagccccagaagccacgcagagccgtctggcctcagtcctgagggctgtggaagccgtcaaaacatcagaggtgcgacacaggcgctgaggtgctccaggatccatccctcccttcctcgctttcataagagaagccttccttccccttcctgctagataaatggctgcccaactagagacgacgcctggcagctttcccagcagccaggtatggccagatgaccaagttctgactaataagatgtgggtagaagtgatgtatgcaacttccagatcacttttatttttctttacagaaagctgcttgccctccaatctttcttccttgctgctggctgagggatcagctgtcacagacccagagatggaagtcacatgctgtagatggaaagctgcccaccagctggattccttaactacctcatggcacagagccaccccccattcaggaccccgtgtccacgttgggactgacagatcaatctcaaccctgctgaccaactctgcaactctccctgctataactgctttcaacctatatttggactatgacaatattaggttaacttttttaaatttggggagtatattcactcatattaggttttagaattgtaattccatctcaagatttaaaatagtccgggcatggtggctcacacctgtaatcccagcactttgggaggccaacgtgggggaatcacttgaggtcaggagtttgagaacagcctggccaacatggtgaagccccatctctactaaaaatacaaaaattagccgggtgtggtagtgcgtgcctgtaatcccagctacttgggaggctgatgcaggagaatcatttgaaccgggaggtggagattgcagtgagctgagatcgtgccactccagcctgggccacagcgagactccatctcaaaaacaaacaaacaaaaagatttaaaataattataaaattaaaataaggtacccttattatgcaggagaaaaaagtcacctaagtgaaaacctgttaaagccaccttctctgtcaagtttgggctttgtgagagcaagagaaagaaacttaaggccacctgagaaggtgtgtaatttagctattcatgagtcaactctattgagatgatatttcaacaaaatggaccatcaactggggctcagaaaacagttttacaaatcgggaagtacaagaattcttcatgaaaccacattagcaatacactaaagcctgcattcgctgcctccacttcccacaccagccggtgctggttcctccccctcagctcccaggctgtgctgccaccatccgtccagcacagggctccctccttgccacttgtgcactcagcagcgcccgccaggctgcactgtcacagcctttgtagggtctgcctcccttccaggctatgagcaactcaaaactgggagggaacgctacaaggaggtttcctggaggaggcaagacctgagctcaagtttgttcacagtatcgaccgaggcatgaggaaacaggcactttcatacacgtcagtgagagctgagaagtggtaaaacatttttttagatggaatatagatctggctaataaaaatgttaactgcatatcctaaactggcaaacacaattctctaagtgtatctgacaaatacgtgtacaagtatccaaacatatttgtgcaagcatgtttgtaacacttcttgtaacaggcaaaaaactagaagtaatctaaaatgcacactgtggatggactgaataaattatggcacagaagtacaacaaggccattcaacagaatgcaaggactttatgtatcaatgtggaaagatgtctaagatacagaaaggaaatacaccaagttgaagaagagaacacataatgcccagctacgtaaacacacacacacgcatacacacgcacatacacaatgctggcaagtagagaaatagtgggaaatgagaaactttcttcccattataactttctattctgtttttcaaatgtacatatttcacatttaaaaactgattaaacaacacatgttaaatgaaaagctgcagaatgatcatttgacacttgtatggaagacgggcttcaggcagataaggctagaggcatgagagtgggcctggctctgaggtacacatttatcaacacccttataacaactagtgagaagcatattactatccccgctctgcaaatgaggaaactgaggcttagaggaagttgtccagtaaggaagttgtccaaattcccagcatggctcagatttgaatttaggagtgtttcaccacaatattcaagttcctcccaaagcaccattctgatatccctttagaaagtgaagctatttgcacatgggctggccaggaccagcacacagtcctgcacatttcaccttgctgactccccctaccaaaacctaccaaaacactttttcctctaacgatgacaacgattcagtgatccacagactcaagtgaacctttcatcacactaaagcttcagagtacccaggacatgcgatatttaaatcaactaactattgtgattaaaagcagattctcacaatcaccctctgtctcaatgcttgctgccgacatttttttcattaaattgttctgttttccagctgggcaagatggctcacacttgtaatcccagcactgtgggaggccgaaggtgggaggatcacttaagcccaagagttccagaccagcctgggcaacatggtgaggcttcaactctatattaaacaataataataataataatagtaaaaatctggccgggtgcggtggctcacacctgtaatcccagcactttgggaggctgtggcgtgtggatcacgaggtcaggagacggagaccatcctggctaacatggtgaaactccgtctctactaaaaaaatacaaaaaattagccgggtgtggtggcgggcgcctgtagtcccagctactagggaggctgaggcaggagaatggcgtgaacctgggaggcggagcttgcagtgagccaagatcacaccattgcactccagcctgggcgacagagcgagactccgtctcaaaaaaaaaaaaatagtaaaaatttaaaaagttctattttcctactgtaattctttattctttcttttctttttttttttttttgagacggagtctcgctctgtcgcccaggctggagtgcagtggcatgatctcggctcactgcaagctccgcctcccaggttcacgccattctcctgcctcagcctcccaagtagctgggactacaggcgcccgccagcacacccagctaatttttgtatttttagtagagatggggtttcactgtgttagccaggatggtctcgatctcctgaccttatgatccgcccgcctcagcctcccaaagtgctgggattacaggcgtgagccaccgcgcctggcctcctactgtaattcttatgaagaatagcttggtataacaacgtaatctttctttgataatcaagaaccttgcagctctcagggccatcctctgtagttcttaagccacagtatataccacaatacagaacaactagcatttggttatcacttcacccactgttggatccataggaccctgcaaggatctccgtcaccagccccacttccaggcacccaggcctgcctatttccctctcaatcccccactcccagggccctgggtaagggcttctcgtggctccttggaccagcgacagcagaagcattctcccagccaccatttctgtgacttccgaaccactgcacacatgccactttagaaagagaaatcactccacgtgagaatatgtacacaaatgttcacagcagctttatttttaatagtgccaaactagaaacaacccaaacctgtccttcaatgggtaaatggttaaactaactgctgtatacccataccatggaataccactcagcaactgctgaaacataccacaacttgggtggatctcaggggcaggatagtcaacgaaaaaagccaatctcaaaaagtcacatcctgtataactccatgcatataacattcctgaaaagacaaaagtatagagatgcagactagattagtacttgccagcagttatgaatggtggggaaaaggggctgctgtggctgtaagggggtgggacaaggagatatctgggatgatgacatagttttgaatcttgattgtggtagtggttataggaattttcacacgataaaaaatgacaatgaactctatacaccttgctccgatgcccaatgtcctggtttagacattttactacagttgtgtaaatatgtaaccgtgggagaaagctgggggaagggtactgggacctctctgtgccatttgtgcaacttcctgtgaatctataattatttcaaaatatggaaagaaaaaagagagatttgttgaaagtgtgcagtgatcacaccattctcccatttgaactccttcaacagtgactgactgcctggagaataagattcagttccctagcacagcacaggagatggcagtcctctggcccaatcttaggcaacatcaaaccacctgggatcagcggacacacccagctactgcacaccttcaggcctctgcctaagctgttccatctgcttgaaatgacttccctcccctttttgacctgctggtcaacattcaccctccttcaaaaatctagttcaagcacttgcttctcttacatgtttcctcctccagcctttcccttcaaaccatgctgggcatgcccccatttttgccaccctcccagtattcgctttagattgcattccgagtctacttacacttctactctgtaagggcagaaaatgtgtctgatttatttctcaatcctctactgattacacagtgggtgcccaaaaaatgtttgttaaagacaaagctaaatgggagaaaaaatgcggtagggcagctgggagcagtggttaagatcgggactttgacttcagactcccagtgggtctgctatttatctgggtgatgtgcagcaagcgattgcactcatctgcaacacggacgagcagagagcctcagggtacctctagataagaagtgcacagcccacttaggaaggcatcttgatgcaggaatgcaccctaaatctgacgaagcctcgtctagatccaattactaacttacagagattacagagaaacacattcaattacactgcagagatgcaatcaatcaaataccaactatggaaatgctaaggaacaactcgattgcttcaacaaataaactaccaagaaaacaaagaaataggagggggatctatggattaagagaaacttaaaagacgtatcatccaatcaacaacgtatggccttctcttgctctactttcaaactattaaggaaacctaaaattcatggggcagctggaaatttgaatattgactagttatttgatgatattaagcaattattactttttcaactttaaaagagtcagtacctttagagacctaccgaagtgtgaagtataactactgtacacctcctgagcaccctgaggttgtgcccgtatgttttacagatgagtgcaatcgcttctgcacatcacccagataagcagcagacccactgggagtctgactcaaagtcctgatcttacccactgctccgagctaccctaccacatttattctcccatttagctttgtctttaccaaacatttactgggcacccactgtgtaattagtatcccaaaaaataatgaatgaaatgacatgatatttaggatttgcttgaaaataattatgggtggtaagggtgcaagtggataccattagagatgaaacaagattggtcaggagttaataactgttaaagcaggacactattctgtttattttgtatatgtttgaaagttcccataataaaagttaaaataaaaagaatgatgttgaaactggttcatacaatcaagtacaaagtatcaggaattaattattctgaaggaaaattatgtaaaaatggcaccttcctaaccaagtgtgaggtgtaactactgtatgtatgtagaccaaaaatagttgccctattggcaaatcaatagtctcaagaagaaaaaaaatctggtctctgttttatcttatgcctcatgaaaacaactggtttactcgctattaactggtttgtctggtccttttctttatccagaaaattaagaatattttatcttagacacattcaagtatcccctctgttgtttatttacgggaccaaataaacagattttaatctgtgaacaaattaaagtcctggcaccctgaaaattaaattgccaggaaaatcaaagctgtcaaaagagaagtctatgcaaaaatagtattgtttttaactctgcaggatccttttgaagaaaaaaaaaagttaaatggaggaaaacattaaatagattggtggtcattcttccagaacaagttaaaagccaaaagagaatactcagagctgagggacccaggaaagaatccttatctgggaagtgatctgggttcgaactccactcaccagctgcttgctaagaaacagactacttagactcctgagcttccgtttccacagggctccagttacaatcaaatgagtatctgggctggcacctgggcaaacagggcctggctcccctggccttaggctacctttcctgctctcctcacagctcctccctcccacacagccagtcctggaggatgacgatcctgcaaccaagctgaatgaatctgtatttggcttggctcacagcattaaaaaaaaatttaattagctattgccaacatttaaaaatcagaacaaatgtggagtgctgccttcctttttagagacagggtcttgctctgtcacccaggctggagcacagtggtgtgatcatagctcactgcaggctccaaatcctgggctcatgggatccttccacctcagcctcccaagcagctaggactacaggtggatgccaccacacctagctaatttcttaaaattttttgtagagacagatctcgctacgttgcccaggctggtcttgaactcctggcctgaagtgatcctcccacatcagcctcccaaagtgtcttgaaattactggcgtgagccatggcacccagccaaattccaccttcttctagaaaactgctgggtaaggttcctgttctttagggtccccacgactctgtgtccttacacctggccctccagactgattctcaactccacagtggcctacggtccttccttggccctgctccttcacacctctgtgcctctccctgcctagcaaatttcttatcaccctcaaggccccccagcaccacctgtcacctcctccacatttccatggcatagcccctcccctatagcaagggttgtacagtcctggaactaagtgtctgcatgcctgccttctctactgggctcctgggctctctcgggaaagggaccccgttgctatctgccttgtgtccgtagggtctagcagaaagcatgacctagataatgcagaattcagtaaatgtctcttgtatgtgtggaagaaagctacagctaaactattataaaaatgtgagattttatatcacagcttgttccaacagttagcaattaaaggggtcaaggacaccaaaatgtttcacaaaatagaacaagcttccatctgcttacaagtttcacacgctaatcagaagtcactaaatgaacagataaagcagagacaacaggcaggctgggccatttctttgatcattcattcattcattgagctgatactactgaatacttcctgtgtgctttctaagcactggggataaagcagtggacaaatcagacagctacctgttttcacaaagttacatcctagtcggggagacagaaaataagcaggcaaataaatagaatagtttcaaaccagatgagagctaggaaggaaattttttaaataatgaaatagcatgactaagggaagaaagagggtggtcgaggagggcctcacccaaaacgagacatctgaccagaggaaggagcagaaagagctacttgtgccaagatcacggagacaactccaaagacggggaaacagcaaatgcaaaggtcctggggcaaatgcgggctggcatgttcaaggcgggcgagatgagtgggacggggcagcagtcttctgggggaggggcgcggtggtaagggattcgggctgggtcccctctggcactgctggacaccgagtgtgcaatgacaaggcaagagaggagtgcgcggggaggcgggaggctgggcgggtggggagggggttcctacaccactcacaccagcacgggccagcaccctgcccagtcttccacagatgcacaccggggtcctgcccaggcgtctgcatacattcacacagcctgacaacaaccctgtccagaagagacatttccccaccttcccgaaggcaaaaccgcggcagagcgagggtcagtgccttggccaaggtcgcggggacgcgaccccgggcccctgggcacccggcgcaggagtgcagctgtctgccccacctccgggagggatggcgcccgcagaccccacgggcaggtcggccgggccaggccggtgagcaggcccgcagcccggggctgctgacagccgggcggaagggggcgcctgcggcatcccccagcacaggggcgacggctgcggctgccagggccccgcagcccccggcccgccccgaagcccccggccgcgcggttccctcaccgcccctccccgcgggcccggcccgagcagccgccgccaggcctagcccgcccgccgggctcacctcgcctccccgccgccgcgccacggggagagggcgggcgggcggactggcggcgctgcgtgctagtcactcctggctccgcggccccggctccgccgccggcccgccccgctccgctccgccccgccgccgccgccgccgccgccgccgcagtgggtgtgaggggcgccggggcgctgcgacccttccggtcccgctcccttctccgccgctgccgccgccgc

SEQ ID NO: 229 - DNA, 14012 bp, Homo sapiens
  source 1..14012: mol_type = genomic DNA
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaag

SEQ ID NO: 230 - DNA, 22890 bp, Homo sapiens
  source 1..22890: mol_type = genomic DNA
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagact

SEQ ID NO: 231 - DNA, 23151 bp, Homo sapiens
  source 1..23151: mol_type = genomic DNA
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagactgagcacgcgtcctccgggtcgcggagcgggcgaggggtcaccgaggccgcggggccgaccggggtcacctgtggcccgggaggctctgcgccgcccccatcccgcgccggccgcctcttccgtgggcgctgggcctgggcgcccggggtcctcgggtccgcggcgtcaccggccgggctcgcggccacgcacgactcacccggccgcgtcgccgttctctgccgctgcgaggctccggaagggaacccaagccggacgctc

SEQ ID NO: 232 - DNA, 24007 bp, Homo sapiens
  source 1..24007: mol_type = genomic DNA
tgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagactgagcacgcgtcctccgggtcgcggagcgggcgaggggtcaccgaggccgcggggccgaccggggtcacctgtggcccgggaggctctgcgccgcccccatcccgcgccggccgcctcttccgtgggcgctgggcctgggcgcccggggtcctcgggtccgcggcgtcaccggccgggctcgcggccacgcacgactcacccggccgcgtcgccgttctctgccgctgcgaggctccggaagggaacccaagccggacgctcgcccgggcccccgccccgctgggactgctggggtcacagccccgcgcggccacgccccattctcggggctccagcgtccccgcgcgccgtcgacccacgcgcgttcccggccccgcgcgacccccaccctgcccccctccccgctcgcgcccccggctttcccgactttggagcgacaaacccaagccagcgtgtccgagcggctcccaagccagacacgtactccagagcggggagcgagcgagcagaacggcgggcagaggcgccggagccgccccggacctcaaatactcgcggggaggcgggcggagtcccgggtctcgagctaccgtcgcccgtccggagcgcgaagggagaggcggggcgggacgtgcgggtcaaccccacccgccagccggaggggccgcgagtcctgcccggaggccttgactttgaccacagtacagggccccaccagcgtgtttatggtgcctctgtggagactgaatgctggcctgtttccagaaaagggccggctcctgatacacggccatccactggggagtgcagaacacgcatttaaaaatgagcagactagatacaggtcacaaagactttgctgatgaaacagcttgcggcaaagaagccagccaggggcgggcgcggggctcacgccagtaatcccaacactgggaggccgaggcaggcggatcactggaggtcaggagttccagaccagcctggccaacatggcaaaaccccgtctctactaaaaatacaaaaattagccgagtgtaatggcgcgtgcctgtaatctcagttgctggggaagctgaggcaggagaatcacttgaacccgggaggcagaggctgcagt

SEQ ID NO: 233 - DNA, 24007 bp, Homo sapiens; identical to SEQ ID NO: 232
  source 1..24007: mol_type = genomic DNA

SEQ ID NO: 234 - DNA, 24007 bp, Homo sapiens; identical to SEQ ID NO: 232
  source 1..24007: mol_type = genomic DNA

SEQ ID NO: 235 - DNA, 3205 bp, Homo sapiens
  source 1..3205: mol_type = genomic DNA
agactactgacttggaccagcaggggaatggctgtgacaataaataagattgggaaaacaagaaggtgagcaaatttagaggagaaaatgaatttcatttttggcatggtgtggaaggctcgggagagaggtctaggcaccagatgtcaacgtgaggtgaaatggatatagctgaagtcaagggtgtggtgaggttttgcagggagagcagggacctccagcaaggccagtgcataagggagaatagagaaaaaaagaaccagaaaaagacaaggagaggccagagaggtgtggaaagaaccagggaagacagttattcacaacaaacaaaagagggcagagttttagagaaggaactgagcagtttggggctccaggtggggcaggagtgggtggccacggttgaggggcagtggccttcaaattggtctgggtaggttctaatgggtcagattggtcagtcctttccaggacactgaaggctgcagaggtgtgactggatgctggtggagggatgcatggcggggaagctgagtcagatcctgaaatcctccaagcatgcgcctgaaatgaccaagggaaatgaaggcggaggctgctgtcgcctggtggcctgggaagggccaagagccagggagctggagggaggagagaacgtgcgacctcagcacggagcactgtaggggaggcggggctggagggagatggcgccgcgctcccggatgaacagagaaagcgacagggtgagtcgcagggcacagtgtgggatgagtcaccgacagcaaggcatggactccgggaagaaggggagacgagccgggaaagacttgcatcggggatgtgagctgagctgcacccagacaaaagcggctcggggctcctgaaagcagcaggcaccgccggtcctgccaaggggctacttcctgcgcggagtaggagagtaggagaccccaggccagtcccaatccccggcccgtccgggatgaggggggctgcgggagctgcgggggcctcctccagggaggacggttgcagggtccctcggccgccgcccactcccgggggcgttccttcctcccagctgcgcccggagcgcctgctgcctggcgagagcccgcccctctgcaaccagcccgctgcagcggagggcgcctgggtgccctcggccgagccagcagcccacggtcggcgccgcactgtcccctggtggcggagcgctcccgcgacccggctcgccacgcctgggaggggtccaggaggacgcggctgggacctgggggctctcagggtggggccttgggggatgaggctggggcccgcgggaaaccgggctggggcgaggaggctcgcaggacttcctgccacagaatgtttcgatgctttttttaattctgcaaatgtaagcctttccactttaagtccaagctcagcgcagaggactgttctataatacatacaatttagtttaaaaatgttgcaaatgttaacatgtgtcacaaactcaagcaatccagtattatagaaagcaaagaatgaaatgtgctgcttctttctcccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagaggtagggtgtctttaatgaaggggctgggcattaagagcacgggggggaatattcgtgctttccttgggaaagaacggagatttttcccggaatcaagaaacccctttttttctgtcccttcttggtctcttccagtcgttgtcatggcgacatgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaatgcctgcctgactgaagcttaatgatgtgaggcttctagtgggataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttcgagcgctagctgtctctcggctgccggctaataaaggactcctgaattcgtctca

SEQ ID NO: 236 - DNA, 3205 bp, Homo sapiens; identical to SEQ ID NO: 235
  source 1..3205: mol_type = genomic DNA

SEQ ID NO: 237 - DNA, 19928 bp, Homo sapiens
  source 1..19928: mol_type = genomic DNA
gggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaaggtgagtgatcccctgtcggggaccgggggacttgggaaggacagttcccggactggacggccagaacgctctcagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaaggtcagtctgtaaagggggtaccggggtttaggcccgtgcgctgcccagcgctgccctgaaggcgcggctgaaccactggtttgcgctgcctttgtcaaggacattgtggcactgtggaaaaaatgaaaaatcagcttctctaacctataatctctctgggaaaaaaaaaaatcagcttttttttttttccccgagacggagtctcactctgtcgcccaggctggagtgcagtggcacgatttcggctcactgcaacctccgcctcccgggttcaagcaattctcctgcctcagcctcccgagtacctgggattataggggcgtgccaccacgcctggctaattttttgtatgtttagtagagacgggtttcatgttggtcaggctggtctcaaactcctgacctcgtgatccgcccgcctgggcctcccaaagtgctgggattgcaggcgtgagccactgctcccggccctctttttcttttttcttttttttttagaagagtctcactctgttgcccaggctggagtgcagtggggcaatctcagctcactgcaacctctgccttccaggttcaagcgattctcccccctcagccccttgagtagctgggattacaggcgcctgccaccatgcccggctaatttttgtatttttagtacaggtgggagtttcaccatattggccaggctggtcttgaactcattcttcttcctttctttttcttttttttttttttttgagatggagtttcactcttattgcccaagctggagtgcaatggcacaatctcagctcactgcaacctctgcctcccgggttcaagctattctcctgcctcagtctcccgagtagctgggattacaggtgcgtgccactacacccagctaatttttggtatttttagtagaaatggagtttcaccatattagtcaggctggtctcaaactcctgacctcaggtgatccgcctgcctcggcctcccagagtgctgggattaatgaaccactgcgcccggccaaaaatcagcttctttaacctttaatctctgaaaaaataaatcagtttaacctttaatctccgaagatcacagccaaagaaatacatgaaaaggaacaagtattaaataatatatacttctagctgtgctgtttatagttttgggaaaaaaatggaaataacctaaggtcccagaaataggaaaatgggcacaaaagggtatgcaggcaatggtttagctgccgcatgaatacacactgaatacactgtgagatgttgtctgttagaatgcccagcacggggactgtccacatggaaagaggcacaggaaaaaaagtgaaaacattataaaataacttcttaaaattaaataatgtacacgtcaaaaatatcagagcccacttgacctggtatatacagtttaataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagttagtcactcagctcttggacctcagattcttattcttaaccgctagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaaggtaaatcatttcatatcactctattttctttttcttttttgagacagagtcttgctctgttgcccaggctggagtgcaatggcacaatcttgactcactgcaacctccacctcccaggttcaagtgattctcctgcctcagcctcccaagtagctgggactacaggcacatgccaccatacccggataatttttgtattttttagtagagatggtgttttgccacattgaccaggctggtttcaaactcctgacctcaggtgatccccccacctcggccccccaaaatgctgggattacaggtgtgagccaccacaactggcgatcattccatattactctccagcttaagaggctccaagggctttctgtcaggcttagaataaaatcctcacccctaccctaggaggggtcaggtcagacccctcccacctccctgactgcatctaccaccatccactctttttttttttgaaccacagttcagccaaacaggctttcttttttttcttttactttctcttttttcttgaaacagagcctaactctgtcacccagtctggagtggagcaatcctctaatctcagccccctgagtagctgggattacaggcatgcaccaccacacctggctaatttttaaaaatctttggtagagatgggatctcactatgttgcccgggctggtctcaaattcctaggctcaagtgatctcctgcctcagcctctcaaagtgctgggccttctgcttccctgggctttgccaggcctccctatgcattgtgatagccaaagtttgctttctacaaagtcacctccaggcagtgactgtccaccagggcactgtagagcctcccagctaatgatgaagtcactcactctcctctctttttcctttaagataatccctttccagacccgccattttggctcaccctgtaagttacagccccacttctcactgccaagtgtgggtgtcactgctggctcagggagcatggatcctgtaaacttgcctcatcgggaggctttgaggagtgacccccaggaactagacaagtaacttgttcttcacaatcactgccctcccaagaacatccaggatttcagcctcagtgctaagacaaccatgtctctccctgacacatgctcgctgctgagaattctaggaaaagcagagggctgtgcaggcgcccctgcccctaggctaggagagctggcaaatgcctggagacccaaaggcctcatcctcagggcggccaactcttctgttttagtgatatacagactatcttttattgtgatttatagtgcaacttaccggttcaaacaatactacctgtattcataaactttctttttcctttccttcctcactgcccagctttaggttcattcttgtaagtgttgctggtgtcagaataggaacctccctgcgctttgaagggatgaatgtgacctctcccacattctccggtgctgtgatgtaccttaaacacagcaaggtacttggacacaaagcctgtgcctggagcactttcagacagacagtgcatggccctcgctacagactcagtgccattgtagatgtttctgcatggaaaatacataaacacaaatatctgcagttgccaatccaccaccatcttgcagccccaagagagccccgggaatccaggttcctttggtatttctgctccctgcccttggtgcatagcctccatccccaggacgacaagaaggctgactgagccctaacatcatcccacagtccagctgggaagagagccagcgacaaagccagagggagctagctcccacacctcccagccccagctgagttcgcttcttgagggtatttcttggaagccccgcctgtgacttctgctgacacctcactggccatctcaactgcaaggcagcctaggaaatgtagtgcttacctgtacacgtggattcctggaatcaattcagggtctgtccttggggaaccagagtggggatattcagtcactaaagatgcaggttcccagctgtccagtgaagtcaagcgaatggggaaggatttgaagtcacctttgggtgtttggagtgatcagagctgtctgccctcttggggagtgacagtgccccactctgttaagtcccatgcctgcccccaactcagcttcagccacaatgatgtagcctcttttcctttccatccacagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctggtggggataagcaccacttttgtgtgtctctgtgctttttgttttgctgtaaagacacactgataggttcacgttgtcgtttggacacaacatgcgcgatgcgtgtcttcacactaagccctagtcacactctctgcattgtttttttatcccattttttcctactgtggtacagaacatctcacataaaattgaccattttaaccactttttttgtttgtttgttttttgtgtttttggacagagtctcgctctgtctcagcctcccgagtagctgggattacaggtgcacaccaccacgcccggctaatttttgtatttttagtagagacggagtttcgccatgttggccaggctggtctcggactcctgacctcaggtaatccacctgcctcagcctcccaaagtgctgggattacaggtgtgagccacggtgcctgacctcattttagccacttttaagggtagaattttctggctgttttcattcatgtactgatagacacttgggttgcttccatgttttagctgttgtggaaaatgctgctttgaacatgggtgggcaagtggttttcaagaccctgctttcagttttttgggttcagagtaacgaatggaattgctgagtcatatgttaattctcatttttctaattgtaatttttgggggcacagcacctctccagcagcggcagcactcgacctttccccagcggtgcacggggttccaacttctccgcatcctcacctacgtgtgttttgttttttggtagtagtagccattctaatgcgtgtgatatgggatctcattgtggttttgatttgcatttccctaatgattagtgatgctaagcatcttttcatggcttactgaccattcatacatctttggagaaaagcctacacaagccttctgcccatttttgcattgagttgtttgctttgttgttgttaagttttatctgagctgtttttttatggtagggagagtgggtttgttggagtctccttgtatctcccagaaggaagccagaatttcagagatggccaggagggggtgaggccaaaggctcccctggggagaactcacgtttttccagagccccattgtgtgccagccaccgcacatagcaactgtctctctctcactcttctgggccatgctgtgactttgttgatgaggaggttgaggcacagaggggtggagggatgtgctgcagggcccacagctacaatgggcagagctggaaattgcaccaagtctgtctgatgcgggggtctcctctgctcctctggcctccgctgcatccctggagaatctctgagacttctggttagagcctgggtctaagccaactcccattattttcaagtgaggggaagggccgacaactgccagtgctggcccaccagagtctggcaccagccgaggagtgcacgcacccattggtggtgtggcggttcactgatcccccagccttctgctcgatctacggggaaaactggggaaggcaggaaggccaaggaggctcaactcctgcttcctaccgtggctcatttcctgggtcctttgctgtatgactgtctggatggaaggttcagagtcctctcaaaaaaggaaaaaagtatgggttttgacatcctgcgtggcttgtcctctgaggcctaaatctccagaagattcctggcctctcttgagaggtctttctctgatgtgtttgcgtgtctgtcaggaagcagcagtgatgcctagatgtggtacattcgacctcacctatgcctctccccaccccctctgggttcgttttgtcttccagattgctggactcgctgaagagagactacgcaggaaagccccagccacccatcaaatcagagagaaggaatccaccttcttacgctatggcaggtaatgattcactattgtggagtaagacttttttttttttgagatgggattttgttgtattgcccaggctggtctcaaactcctgagctcaagtgaccctcccacattgaccttccaggtgggagttagactcttaatcagaaattggatacattgttgtaaaaaatccaagccacgtggaagtgtataaactatctggaattatcttgttttctatgttctcacttgtttcattgttcctttcgactccctccagaatttaggttcctcaaaagtggggccctgcctatcctgtctttgctgtgcctccaggccctgaaattctccctgggctgtagcaggggctcaagtgaatgaaccccaggaggcatcttgggtaaaaattcagtacgattctatctttgcttttgcaactgcttatcatgcacatatacatgaacatgcaatctctcaactttttaatttcacctaacgatataacatggagagcctttcgtgttagaacgcacaggttcaccttactctatacattatggtgtagattcggattttcgcccttggcaccactgacattctgggccagataatcctatgttttggggggtcatcctgtgcaccctgtttagcacctagcaccatccctggcctctgcccaccagatgccagtagcacccctcccccaccggctgtgacaaaccaaaatgtctccaggcattgagaaacgtcccctagcaggcacaacactgccccagttgagaaccattggtgtaggtatttcatttgcatctattctcctgttaagcccctaagtatagttcctttattgaaacaagagtctgagaaagtaaaattaaaatgttaaccatgaatctaacttatggaattcaacctttgtagccagctcaatgccctgaaacccattgcttcaaactgatacgtgtatcttttccttaaagtgtcattatgaaaaatttaaatcaagagtttaacatcttcttaaaggtgaccagggtaaatttaattaagcaaatcaccaggctgcctcccagacgaagtcagtatataagcctggagactctttccaatgaggaaaatactgcttcagaagcccctggtgtgaacgatactgccagtgccaggagggcctgactcttcctagagtcctctttgttatcagcatcaccactgaaagatgggctccatgtggccctgccttcccatgagaccagcgggtctgattcctcatgttttgtttaagtgtcagatttgatggactgggggagatggaagcagaactgtgccacactgaaaggtgcctgtagctgatatctgcaaatgtagggttagcatggaagactaattccagcagttctttattttggtgttagggagctggtctaaaccttcttacagaggataaccaaattaggttgggcttttaaaagatttagtggtggtatttttgaggagatataatttgacccattgtattgtgatgttgagctatgaataactggatttttaaaatgcccattgctttaaaactgccacctattagaaagtttggtatttctggggccaggtgctgtggctcataccagtaatcccagcactctgggaggccaaggtgggcagatcacctgaggtcgggagttcgagaccagcttgaccaacatggagaaacccggtcttaactaaaaatacaaaaaattatccgggcgtggtggcgcatgcctgtaatcccagctactcaggaggctgaggtaggagaattgcttgaacccgggaggcagaggttgcagtgagctgggatcgttgctccagcctgggcaacaagagcgaaactctgtttcaaaaaaaaaaaaaaagaaaaagaaaaaaggaaagaaaagaaagtttggtgtttctggccaagtgcggtggctcatgcctgtaatcccagcactttgggaggccaaggcgggtggatcacttgaggccaggagttcaagaccagcctggccaacatggcaaaatcccatctgtactaaaaatacaaaaaattagctgggcgtagtggcacacatctatcgggggaaattcagccagatattgggcgaaattcacccccaatatttcacgtaggttcttttctatatttcctaagtgtcggccggtctgagaaataaacggacagagtacaaaagagagaaattttaaagctgggtgtccaggggagacatcacatgtcggcaggttccgtgatgcccccaagccgtaaaaccagcaagtttttattagtgattttccaaaggggagggagtgtacaaatagagtgtgggtcacagagatcacatgcttcacaaggtaatagaatatcacaaagcaaatggaggcagggcgagatcacaggaccacgggacggggcgaaattaaaattgctaatgaagttttgggcaccattgtcattgagaacatcttatcaggagccagggtttgagagcagacaaccgatctgaccaaaatttattaggcaggaatttccttgtcttaataagcctgggagcgctacgggagactggggcttatttcatccctacagctggaccataaaagacagctgccgccccgaagcggccatttcagaggcccaccctcagggacgcattctctttctcagggatgttccttgctgagaaaaagaattcagcgatatttctcccatttgcttttgaaagaagagaaatatgtctctgttccgcctggctcaccggcagtgagagtttaaggttatctctcttgttccctgaacattgctgttatcctgttcttttttcaaggtgcccagatttcatattgttcaaacacacatgctctgcaaacaatttgtgcagttaacacaatcatcacagggtcctgaggcaatatacatcctcctcagcttatgaagatgatgggattaagagattaaagtaaagacaagcataggaaatcacatgggtattgattggggaagtgataactgtccatgaaatcttcacaatttacgttcagagattgcagtaaagacaggcataagaaattacaaaagtattaatttggggaactaataaatgtccacgaaatcttcacaatttatattcttctgccatggcctcagccagttgctccattcggggtccctgacttcccacgaaacacacctgtagtcccagctagtcaggagactgaggcatgagaatcacttgaacctgggaggcagaggttgcagtgagctgagatcatgccactgcattccagcctgggtgacagagtgagactgtctaaaaagaagagagagaaagagacagaaagaaaagaaaatttgatatttcttagcttcaattactatgatgcacctgaacattcaattttcatcttagtcttcattgaatttaacagagagaggttgttcttcaagaggaactgtttcttatcctgatttaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtgagtcatgggataaatgctctatttataaaaaccatctttatgttttttactttaaaaaatgttgacttccagctgcaaaatggcattatagaagcaagctagcttcactttccaaaaacaaatagatagcactgggattatcaccagcagtatcccagaagtcaaatatgaagatgaaatagttcccaagaccacacataagtgaaacaactccaagcagacggtaagagattggactatcatatccacgacacccctccccacaaactacccagcaccagctgtgtgggaaatttcctcccaagtcacaggttctacactggaaaagagatcaagggggacaatcagcttctcaattttctggggttcccagaaacaggcaggaaggagacctgttcctgcctcaacccacaggaagcatcaggagtgcctaaagggagaaatatccctgacaacagccagagacaaaggagggagatgggaatattgtccccagccctggaaactctgatctgtaacttagccaaaggagatgccaaaccagagtggctgttcagcagcaccacactgtaggaggtacattctgcaggtttcctgggcatgagctgctagccagccttcccacactaccatgctatcccctttggaacctctcatattcaggactggcacactctgaacagtaggttactagagctgaggcaaacgtgggcataaaccaccatctagtgccaaaaagcaggtggtggcttagtagaggaaaaaaaaaaaatttaataagaaagttgcaaagactttctaagcaaatatatgtaataaaaatgaaaacaagtcagacatagaagactgaaataaatagatgtcatccacaagaaacaacagtaaacagggaaccatgacctctccacacagacaaagcaaggaaccagtgactgaacctaacgagacggcactgtttggactctctgaccaagaattcagaatagcacttttaaggaaatgtggtaatcctcaagatcacacagaaaagcagttcagaaatttatcagttaaattttacaaagagattgaaataatttttaaaaaatcaaacagaaatcttggaactagaaatacatttgctgaaaaattcattagaggctctcaacagcagaatggatgaagcagaagaaaaaatcagtgaactcaaaggcaggtgatttgaaaatacacagaggagaaaaaagaaaaaggtatggagatttcttacaaaatatagaaaattacctcaaaagaccaaatctaagaatgattggtgcttaagaggaagctgagcaagagcaaggcatagcaagcttattcaaagaaataataacagaaaaattttccaaaacttcagaaagagataaatatcctggtagaggaaggtcatagaataaacagatttgactcaaataggactaccccaaggcatataattattaaactctcaaaggtcaagaacaaaaagaggatcctaaaagcaaataacatgtaacagagctccagttcatctggcaacagacttctcaacagaaaacatataggccaggaggtagtgggacattttcaaagtgctgaaagaacaaaactgtcaaccaagaatactgtacccagcaaatctagccttcaactctgaaagagagagagtctttcccaaacaaagaaaagctgagaaaatgcaccaccaccagacccaccttacaagaaatgctaaagggaattcaataagaaagaaaaacactaatgtgcaaaaagaaaacatttgaagatgtaaaacccactggtaaaagtaagtacacagaacactctaatactgtaattgtgtacagtccactcattactagtattaagtctaacagacaaatctatcaaaaacaataatcactacgtgacctgttaagagccaaagataagcaatataaaatatgtaaatcaagacacagatactcaaaaatgtggaggtgagcatgaaattaaagcgtagagtttatttttttagacctgtttggcattgaacaagacatccagcctctcttgggtgtcagtttgctctctggtaaattgggaaatacaccagtctcaccagttgttatgaagaaaggtgatgtgtgtagagcacagcacctgctaggtagcaagtgctcaatcagcagccctcccagactgcttctctttccctagctcggacccagggtgcagcttctggtcaggttgcagcaaatgtctttgacttgtctgaggagtccggtatacacagtgctactgggatggttgggatgggctgtggatgcccacctaggagtgagaatgtttggcctcttccccgacaggtactctttctaatcctgaggttttcaattatggagtggaaacccacgaagcctacaagcaaaggtctctggctagcgacatcactgatgagcagaaaaaggttcgggaggctgacctagtgatatttcaggtttgtttttctctaattaatatattgaatcagattcatcttatgtacaaactctttctgaatattgagttttgtgctgcttctggaagtggcatcaatgttttgagcacagttgcacacttactgagcaaatattgtaacctggttacaacacctagttacaacatttcacctagttacaccacttcacctagttacaacacttcacctagttacaacacttcatctagttacaacactactttaaacactgtacgtagatgtaacactactttttttttttttttttttttttttttgagacggagtctcgctctgtcgcccaggctggagtgcagtggcgggatctcggctcactgcaagctccgcctcccgggttcacgccattctcccgcctcagcctcccgagtagctgggactacaggcgcccgccaccacgcccggctagttttttgtatttttagtagagaccgggtttcaccgtgttagccaggatggtctcgatctcctgacctcgtgatccacccgcctcggcctcccaaagtgctgggattacaggcgtgagccaccgcgcccggccgatgtaacactactttaaacactttacctaattgggtaaagatatccacgtagccaatatcactcactccaaatcccgactgccatgtaaataggaatgaaggatatttccattattccagtggtccaagaatcatctgaaacctgccagtcttgttgcttcccttctcttcccgttcctgccctgagacattctggggctgcttgagaaccacatttatctgcacaaatgtttatcagggtaaatcaggccaaatgcatctccttaaatatcctgccttaaatatcctgatcattaagaggaaaatctctggtttctaccctctcagtggttgcttcacccccagcccagccaccttcctgtatttgttcacaaggaggtgatgccactgcagagtgaactggcccagcaaaatgccctccaggagtgctgactcatcaggccacttcccgccactgcaaggaagatgtgcaggcatggctgtggctgtgtaaacctggcagcagagtacgcacatgagctttgagggaattgttgggtgacagaaattcctgtccaactagaaggaaaggggaatctattataagggctctggtcacttgggcctcctggatcccaaggacagagctgtagctgctctcgtccacagattcccatctgctcctttctgcctcttggctctgttctctctcactgcttgccagggactggatcccctagatccagaatttccaaccaagggatctgattggttcagatcatttctgttttccaaccctgcttgaggatgcggagtgggcaggagaacgagagcactgttcgcatgagtccgccatgtgagggcaaggcagggggtgagcggcatgtgaccactttccagacaaaaccacctttccagaatgatgaggttcccaagccttcataaaagcaacctgcatgtgcgggaagagggctgcctcatccctgcccaggcttgcctctgcacaccccttcccgacaccagccctttctttactcagtgaccttgagctgctaatctgaccaaagtgcaggacgtcctttgtcctaattacaggtgggtggactcatagtcctcaggcctaggtgaccatgtggtttaccatctccgtcttaataccatgccagtatgacgggcctgtatcctggggtgcgtggtcccagcagagccacgctgagctctctgctctgcttctcctgtcccccttgggtcggccggccacgtggagcccgctttcctcctcgcacccactccactcccataacccggtggctgggtaggctaagacctggcctttctataatggcctttcttttgtttcacttcatttcactccatttccctactttccctttttttctgatagtttgtccagagggtctgcattataagttattcttttattcaacattaataaaaatttcattcatcactactgcactactaatatcagagcccaccactcactgagcattgattctgttttgggcactgtggtgtgtcttcgaatcctcaccaggatgctgtgagctgtgaactattagtagccctatttgatgaatcaggaaaaaggaggcacagggaggtcaagtaacttgccaatgtcacacagcagcaggtcgtggagcttgggtttcaatgccaagtcctgagtttgttttatatggaaagcacaagagacattggcttccacctttggtaacagatgattgcctatgtttatttcccttcccaggcggtaacactggatgtaatgttagggcatctatgggatagggagatcttagcgctggtctaaggaatacaaacatgactttagttggtgtctaaatccatagatgctcagcaccgaactcagtctgacttccagatgctaacaacacaccccaggcaggcgaaggggcatgcttttccatactcttccttttgactggcttgatcacagactgctgctccaaagctggtgttacgcacagctcctcgtcccctccctgcctgcccagggccagcatcaggggctgtcatcactgggggatgcagagctacctgtaacagcaacaaggaccattgtcaactccgttcccgtctgacacccacactgcacctttcagagctgaccataagggttaccctcacctgcccagctgccagggaagaggagggctgtgggcttcattccgaatcaccagataaactaaactaggaaacctgaggcgagccgcagcctcagtttctctttggtgttgccgcccacagttcccgctgtactggttcagcgtgccagccatcctgaagggctggatggatagggtgctgtgccagggctttgcctttgacatcccaggattctacgattccggtttgctccaggtatgtgctcttggataaggatcactatggatagttggagggaggggacagaggatgcgtcttctatcaagttatatttctagtttccttccttttcttagcaaatatcgattgagcacccactatgtacaaagcaccatgtgctgcacacgggtggacacagcatcgtttctgaaatcatggagctttttgtctggtggggctgcgaacacatccacagcatactacacgcatggcaaacaagggagtgggtcaggtgtcaggtgacgggggacctgggcaaccttatgtgggcaacccggtggccagccctggctccagagagagtatctccctggtgcagagcccagccctggcctggcacaagttcacccccttgagcatcatgtgcctgctgtgagaaaagaccatgcgacacccacgtggcaggatgaggagggcatggaatctggtagatgtgccacatgtggtagctatgaattcttactaaaacaatgatttttaaggctgggtgcagtggctcacgcctgtaatcccagcaatttgggaggccgaggagggtggatcacttgaggccaggagttcaagaccagcctggccgacatggtgaaaccccatctctactaaaaatacaaaaattagccgggcatggtggtaggcgcctgtagtcccagctacttgggaggccgaggcaggagactggtttgaacctgggaggtggaggttgcagtgagccaaaatcgcaccattgcattccagcctgggtgacaaagcgagactctgtctcaaaaaaaaaaaaaaaaaaaaggaacgatttttaaattctaaaagcttcagaaaataaatgcacgtaagggaaacatactgagtaaccaagatgtgtcttggaccatgaatggtgctaccacttactgagcagccctgtgtgctgggaaccttgtcctgtggtcagtgcctcggccgtatccatcacacatggtgtcatggaaaccaggtttccaccagcaacctgggcatgttagagcttctgtgtctgcttggtccattcacttggattgtctcctcctcctcttgggatgtcattgtcacctatggatgggagtgttgcatttgtccatccctggagggtgtccacacgcatgttccctgctggctgtgctgagcccgtgtgctggaggctcagcaacatttctgtcctcttctggagtccacacaaatgcatctgctttctcccttgcagggtaaactagcgctcctttccgtaaccacgggaggcacggccgagatgtacacgaagacaggagtcaatggagattctcgatacttcctgtggccactccaggtagaccagctgcgagtggctcccttgcttgttggcacacgcacacacagacacacacatgcacacatgcatacacacacacacgcacacacatacatgccctcagctccccgaggggtgagatgagatgggatggaagcgtgatgccccacaccattttgactcccctggatacaagaaaattataacattttgccccttttaaatgctttacttgacagatttgaaaagcttgaccaatagggaaaacatgccctaattatagcttttgatatggtttgggcagaagctaagccaaacctgcttagcttggtcagcagaatggccccaaggtggccctgcgtgtgttgtgatacgtgcgggtggaggccatccatatggctctggcagtgcttggtgagggcagcactgcccttggaccctggcaagtggcaccccaggccctgcattctgatggccgcatgctggtctctgctggccatgccaacccccacaggggcaaggggcctatggagccagcacacacccacctcccagtccgcaggcccctcccaggcctgcttccccaggggacctcttggtgcctgcgtgagtgtccctgggcctgaaatgtggccgagtagtggccacctgccaaagggaaggtggtgggcagagcagttccaacgtgctggggtgtcccacgaaggaacccctggtgaggggtggcagagggagggagtggggagcagactccaggtcaggggctccagggaacccagaaacctaggggtcaactgttcttccaggttgtttaagggaggtttgtcgagacagggggagagctcgttcttgaggggtagggagtttgctgggaaaatgcacgcgtcaccccttttctgtgaactctctctaggtgcacgtgccttgcccatgtcctattggtttggtattttttaattttctatttgtcagtgctcttcatatatcagagaaattaatcctattatgtcctttcaaaacacaatgatttttccttctacaggcagtgcacattgactaagttcattccttgcttttgttgttgtttgctattataaataggattttgtcttcaattatatcttctaaaagttcttttgattggtgaaagctattgattgctgaatattggtttttgaccccgaccatttgctgttttctcctcctaatcataattttttcttagttggtttccagtaataaagtcatgttgtctgaagctgggtgcggtggctcacgcctgtaattccagcactctgggaggctgaggcagtggatcacctgaggtcaggagtttgagaccagcctggccaacatggcgaaaccccatctctactaaaacacaaaaattagccgagtgtggtggcggacacctgtagtcccagctacttgggaggctgaggcagcagaatcgcttgaacctgagagacggaggttgcagtgagccaggattgcaccactgcactccagcctgggcaacagaatgagaatccacctcaaaaacaagcaaacaaacaaacaaataaataaaatgatgttgcctgaggaaaaaaatgtggatagtggtgtgtgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcacaggccaactggtctcttatgtgtcattagccaagttcaaattcttcttgcttttaaaaaaatctttttttttttcagtttgcagaagtacatattatggccaaaaaaaaaagagacaatatgaaatataaaaagagaaaatccctttaatccctcccacctcagaaagaatcactttaaatggtttgatttattttcttagggcctatatattttctcacatacataatttttattataggtttattacatttactgctcttttacatgaatggtatatcataaatacggcttaaaatttgtttgttattttcatttaacagatatcttgaacaaacttccatggtatatattatagctagaataacctcattctggaataatctatagtgtgaatgtaccataatttgcccaatcaagcagaactataatgtttggcatctgaatcagttgcaaagattgtaggttaattgcagttataaaaatagagcttggaaattgcaactgccccaagttcttcacggctcttatgcaaggctgtgtcctaaagccatagggaagtttagctttcagttgcctgtaacattaaggttgtttcatgattttttgaaggtttgtttcacaccatttccccccttaaatcatttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgg

SEQ ID NO: 238 - DNA, 4616 bp, Homo sapiens
  source 1..4616: mol_type = genomic DNA
gtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcactcactgagattttcttttctttctttcttttcttttctttcttttttaaagagacagagtttcactatgttgcccgggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgacagtttctatttttcatagaaaagttgaatctgggcctgttgcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaattattttaatttttggtagagacaggatctcattatgttgcccaagctggtcttgaactcctggtctcaagcagtccacccacctcagcttccccaagtgctgagattacaggcatgagctgcctgcacctggactaatacagtaattttactgtaccttttccatgtttagatacagagatacctattattgtgttacagttgcctacagtattcagtacagtaacatctctacaggtttatagccaagggcaataggctctaccataaagcctgggtgtgtagtaggctgtaccatctaggtttgtgtaagtgcattctatgatgtttgcgtgacaatgaaatcaactaattatgaaatcacttaatgatacatttctcagaatgtatctcttttgttaagtgaaacattacaaaatttatttttttgggcacagtggctcactcctgtaatcccagcactttgggaggccaaggcgggcatgccgatcacgaggtcatctcctacaggcagtgcacattgactaagttcattccttgcttttgctgttgtttgctattataaataggattttgtcttcaattatatcttctaaaagttcttttgattggtaaaagctattgattgctgaatattggtttttgaccccgaccgtttgctgttttctcctcctaatcataattttttcttagttggtttccagtaataaagtcatgttgtctgaggccgggtgcggtggctcacgcctgtaatcccagcactctgggaggctgaggtggcggatcgagaccaccctggctaacacagtgaagccctgtctctactaaaaatacaaatatttagccgggtctggtggcgggcgcctgtagtcccagctacccgggaggctgaggcaggagaatggcgtgaagctgggaagcagagcttgcagtgagccgagattgtgccactgcactccagcctgggtgacagagcgagactccgtcaaaaaaaaaaaaaaaaaattaatggctgggcactgtgggtcatgcctgtaatcccagcaatttgggaggctgagatgggataactgcttgaggccaggagttcaagaccagcttgggcaacataatgagacccatctctacaaaaaatttaaaaatatacattagttaggcatggtggcacgcacctgtaattccagctactcaggaggctgaagcaagagggtcacgtgagtccaggagttcaaggctgcaatgagccatgactgtgtcactgcactccagcctggatgacagagcaagactctttttaaaaatagccaggcgtgatggctctcacctggaatcccagcatttttggaggctaagatgggcagattgcttgagttcagcagtttgaggccagcctgggcaacatggcgaaaccccaaccctataaaaaaaaaaaaaaattagccaggtgtggtggcacacatctgcagtcccaggtacttgggaggctgaggtgagagaatcgctcgagctgggaggcagaggttgcagtgagctgagatcacaccactgcactccagccttgggtgacggaatgagacctgtctcaaaaaacaaataaataaataaaaataatttaaaaatcattaattgccagttacaatgaaaatttaaaacttttaaaaaatttagtctgatggcattgtaccactgtgccgtgttcacgtaaccctactaataatcaccctgacacacagccacatgcagatggaggaacttccctaaaagcaagtttgagggattaaatatcatctttgtcatcatatcctcctcttttcccttttcctcctcctccttgtcatcactactgaggacagcactgctggctgtgcccaggggcccttcttcctcaacgcccccagcaccacccaaagtccccctctgtggaatcggagcactgagtgtgttggcctcagggacactgaaggaagccgcccgcccgtcctctcagccttggagtctgttcaaccattatcattcaaaccaccttccatcaaaggtttgaatacaatgagcagctgctcctgcattcctccaggacacaggttcaccagctgggtgtctgtcaaagacaatgagcctccgagttggtccaaacttgactctccttgaaggtcttctctggccatcctcaaaatccacaggatgaaatgtgttcgatgaggacaactcactcgtgtcgcggcgtttggatgggctgcggcgtggccgcttctgccgtagagacggagccttcctgtggttcgcgcacttccttcctgaagcctcatatttcccattccgttgatacttggccacctcaacctgcaacgtgcagtttccagtgtcatcttcatccaaatgcatgaatgcaagatccacagcttccctcttccaatgatcgcacagcctgtctcctttaagatgtccttggttatctctgtaaaacttgaccttaagttcttctgtctggggatcgctcataataatgccaaatggacaggcgtgtgaatgcctccacggtaacgaccagaggcaaaccggcacatacacgtttgtatttctccttcttcagcatgaagccttcctttttctcccctctttgtgggatcagtgggtttggggtttttcttggtggcagagcagcgccgtcaccgagcagccgtcgctggcctgatatgcagcggtgaagtcttcactggtttctcttctgctcctgtgtgcttgcagaaaccgggctggctcttgattgggattgtaggctgcagaggctggggaagggcagacagcctcgggagacacgccggaaagggcggctccctcgtgctcctcagtgactcagggttttggccacatagctcccctcctccaccctcgctcagcaggctgcatccggggcggggctggcaggcaaagaggctgtgtcacagcccttcagagcctcaagctggggtccctagggtttctggacctcagatcactgtgaggcaggaggtcctccaccctccctccggcaactctgaagtatgggaaggtgcgttctcgaactgccgaggggcctgttcctgtgtgggttgagaggatgggaagttgctgaaatccaacctctctgagagccggtgctgtcaccttggcctgagtatgctgaagacattaattccggttcccaagcaaaactgttagcaattcgagggctgggctcttgcctatgtctcatctcctgttagtaccgggcaccctgatacattttctgccggtttttaagaatttttttttgagacggagtttcactcttgttgcccaggctggagtgcaatggcgcgatctcggctcacctcgacttccacctccctggttcaagcgattctcctgcctcagcctcccgagtagctggaattacaggcatgcgccaccatgcccggctaattttgtatttttagtagagacagggtttctccatgttggtcaggctgaactcacccgacctcaggtgatctgcctgccttggcttcccaaagtgctgggattacaggcatgagccaccgcgcccggccggtttttaagatcttattgctgaaaaacttaaaataaaaaataaattcagtatcagcagggcagcaggaattgccatt

SEQ ID NO: 239 - DNA, 472279 bp, Homo sapiens
  source 1..472279: mol_type = genomic DNA
aagtttacagaaatgttttatttctttttgaaaattaccttgtagaaatgtgacttttctatcaaatatatctgtaattagtcaaagtgctatagtgtatgttgaaatcaacagttctatactcaatagtatttaattccttgtgcttatagttttttcaaaattggcatagactataagttctgaaagcaaaatatggaatgcatgaattttaaatgacagaattaattaaaattctttactgttattgacacgtacaattttatagaagcttggttgaataatatttgcatatgatttacatttgatttcctcatactcatttttgcatatagtttgcaggcatttcaatgtatagtaatttcatatatttggagtaagactgatagatggaagggagtcattcaactaaattgttgaaaggggaaggccctgagagagctcaactgttcttggtccttggtggcctcactgggcagtaacaagggcaagtctattgaagggcaagttcaccttgatcagataagctgagtctcgcactctggaagagacttgaagttctgttggtcaggtactttccctgaacacagtccctgccccccaaaaaatgtccccctccccaaacaaaaagcatggagaaatggtcaaaacaaccgtggctccatatatacttctttctcaattttgaaatctataaatatttatagatgttctttatttgacaaataaaaattgtatatatttatcatgtacaactcgatagtttgaaatatgtatacattgtggaatggatcagttgaactaattaacatatgtatcacctcacacactagcattttttgtggtgagaacacttaaaatgtactttcaaacacttttgaactctctagaattttagcttgtccaatctcttgagagaaatgagtccatcaatacagaaaatcagcaatgggaggcaagaagagattctttgaactaacacaggaaaaaagcacatctcaatatttatttagataaagggtgtagattgtcactgctgggaaatatttgctgggttacccatgttaacgatctgaataaatttagagttggcctacagtggtgctcaaattggctcatctccagacatgaatgaacatagagctgctctctttgcttttggtgtttccctaattctctcatttttttttttttttaggagaaagaggagtagcttaactatgggttgaggaattttagctagatgccaaaattccatgccacatgctagagcctggcaagttactgaagatgtttatagctgctatttaggcccaaagagtcaattctggcctcagggatcacaggcttttctgggatggaattagtaagataattatggttattcctacgcagagggataggataaaacatgcctcccagaaagactggtcttgtgacacatagaggataaataagaagataataaaaattggaagaagggtaaagaaggggcagaaataacagagctggcagctaactctttgtgaagggcgaaatagaatgaagagtcatgactgacttctagatttctggtctgagtgcagtgatgtcattcattgagttggaaaaaaacacaaggagaagtaggtttttgggctgtgttaacttcatagtaactataggataacctactggatattctcactaggcagctaaatgcatggtatagagctcaggaaaaatacctgtggaaaaaaaacttaaaaagtggtgaaagaatccgaggaaatgaaagaaagcatgtgcaggtaaactgaggcagggcaaggactaagactgctaccattttataaacctcaaaagccttcacttctgaaatgtttttttccaaaaagcttacggctctttgaggatccaatgagtatactaaagtagagattgcaaaggcaaatgacttcaagaccgagaatctacaaaaaaagataaataactggttataacagggactaattaaactagggaaggcatgttctgcctaagtcattcgagtttttttttgtttttcgtttttaattctgttggtgcccaagcaaaatacatcatctacaaagaggacttactcagcatggcagccagcttgtgcctccagagtaaacgtctataaaccaacttcttgcaaatcattccctgaacacagatagcctggattgaaatctcctggagagcactgaccttaacatctacttatattttcttccaaatccaacacagtgaccacagagaaggctacctacctccttttagggacagcctgaagatctgcaatactcaccagatgcctaaagaagaggttaaaacatttctgccaattcttagtagggtgagacacacctgccccttgatgccctgcagacataacagctgtctgccagtacttctcatagaactaattcagggcatcattatttagaattcagcaatgaaagagtgtgtttcctttctctcttccaatgcaactacacaacaaccccttaacattgtagagattggaaaatcctggttttcaggattttcaggaaaatctgagagcaatctctttttggaagctctccacattcctgcgatcttttctttacatgcttggagcataaggccttctggatccagagccaaggacacagtcaggctgtttaaagtattcttcagtttgaaaagaaatgggccccgtacaaatgtgtgaatttggtgaaattgcctttaacaaccttaccaaatgtatcaataccaggtgagcctttgttctgatctccatttaaaccccctgcacagcctagagcagttgcatatgacataatctctcctctccttagtatcacagctttatgcatcatcttctccaaaaagcagctttttgataaaggacttggccacttggctttctctgatctcccaatgtagttcttttccagttgtaaatgtgacccagctactaacagagagaatcactgaaaaatagaacagtggtcatacaaaatttcctttcccaaatttggcatttttacatctttgtccttaactaaactctcagcaaagcccatgagaatatcaattttcatgtgtaaatcctcatgaagtgcaaatttgatacgctcacactactgtaggttctcaataatgattgaatttaaaccatgaaataaaatccacttgtaaaaagccaggaagttgccttgtggttggaaggtaagctctgacagatcagggagcagggtgttgaactgtcccttcaaatgctactacaggataaagaaatgcttttctgtaacagtgtggaattaaactgtagctgaccagaccttttcatgatcccttctataaaagaagctcaaagcattgtgggtggtcaatccagagaatgcttaataataacccctgctggtataagtcagtattacaccattatcaagttgttaaaatcaggcttaagttaaaaactggtaaataattaacaagtgccattatttgcctagcattgaactaggatcatgatagctgcaaaatatgtatgagacatttttcagtctgtaagcatttatatgactgttttccattttaaagttgaaaaagggattcagagtccacattctctcttcttagttgtcccagcaggacagtcctcacttccccagcttattatccagaaatactgggaacattctgcctttcaggccaaatgcccccaacttccctgatcacagttgctcctgaatagtttccgggtgtactgaatgaaggcagaatgcctcagtggccccgcaggaggctttcttctcttgggaaagccccaagctgccactttgcttactcagccgactttgccctggcaactgctgcctctcttgtctgaagtctgggcatagcagcagcagctgattttggcctgccagctggtatctgagcaactgctcttggccctccttccagttcccagtctcttgcaggtacacctgctgagcaggagcacctggagcacagatgtgcccatgggatgtgatgccagtagtaccaggagcaggcacagcagcctcttcctctcggacaatgtggcggctaactttccttctggacactccattcatcaactggtgggggcactggttcaccttgcccagcatgaccttcattctcatatctggggggaaaagaaataggggaagaaatggatttagttttcaaccagttaattacacattttgcatacttagcatttctgacaagatattgtcaaatcaaagattgaattacatcagctctttgatttccaaatatcttttatcagacactccaaatatgtaataaaaaattggtaatacttcttcctcaaaaaatacttacatgatgttgataattgaatgaggatttttcattgtaagcgctaggcttcaatgcaaaaaccagaccatggtcaggccttaccaactggccaactcacacttaccaacaggccaacttaccaacaggccaacttaccaacaggccaactcacacctgtgttaagagatatgaactataaaaaccagtcctatctaatacttaggctcttataccaagttcacaatgtaaatatctttggtattataaaaacatgaatataaatatttgcagaaataatcacataaacatctatgtatatgagtgtgtacatgtatggttgcataacagtagaaagagagatggcacattacactcaagtcacaaaattaggcccaagttccccttctcctgctatctggcttcatgactttcatcctttcagcctctctgggctttagttgcataatttaatttattctcaggtgctacttcaaaatttactaaaatatatttattttaacaatgttgttttaattgatttcctctttgacattttatttgtctcttatttttctattaaacagacctaaacatcaactcagaagagtacaatatacataaacagatgatctaggcaccatataatactgtgtaaagataaagactgcaatggaaagttaagaatgttcagtgggatacatgcatgggagtataccatgcatgcaaaggtcactattcatatgccttacagtgagaaaaaggttgaacttgtcctaaaccctggggggtagatggtaatactgtcatctacttttactacgtttactgtccctgcttttctcacatctcaccaccaaatacattaaccacgcatttgtatgtattgaagatccttaacttattaagctttttgttatttttttcctgagttcattgagagctgtcttggtttgtgttaggagatagtaatcctgtctgattcatactataagagacagtattgggatagacaataccaatttcccacttcaatttaatctggaaaatgaggtaaggatgagagaaagtaataacattatatatacatatatatatatgtatatatatatatataatgcttttgatttagagcagtaaaaaaagataatcatgttgttcctattatttccatgacacatctactaatattatgataagcccatgttattcacattttctgtctcctgttccacagtccatttgtctagcatgtatcttctacagccatcaaactatgggatgattctcttgcttagagctataagaactttcaggttaccctagttttcctaaggaacctgcagctccttccagaagtgtttcttcacagctcaaactacattgatttatgcctcaatacttgtctggagtttctcatttgacctgcacagttgcttctattattagtcacctttccttatgtaacagtctcatcttcctcttaggaatttgagttccttcaaggaagaaatgtttgtgtgccgtcaaccttgctccctcattatgcccagtcctctgccaagcactgagctgggcatcatctccataattactgctcccaccaggtggaaaagacatagtttatcaggatcagcaaataaccaaagaacaagaataataaattatcaggtagaagcaaactttaaaaagacaaaaaaggctttgaattttaatcccttggtaaaaccaatagtgcttcatacaagaggaatcaaacactgcaagtcgcctattttcaacccattgaagatactgttatcttgtttttgagagaccttcattggaaatcttttcccccttgttctttaagtccgcatctattcatgaaagactaacacaagcatagctttcctttgcagaccccaaaacatttaaaaatctcccatgaattatttacatggcagctccaatcagcaacatacctgacagactccccagccgaaatgaaagttcactgtgtaaaggtgcccagagaggctggccacctcctactatgaggttatagacagaactaagtcagcacacattatgtgtcagcgccgacatcagaaggaatcaaatcctttgatcttggacctccacaggaagcttagatctcagacaaattagataaaaaatgaatttatagcagatacgtgtcctaaggcattcagctgaatgtttgggttttagggaaggaaggatagtgagtatcaaaacatatgaattgtcatgcctcctttccacctctgccttgttgatgagttcccattaaaatgaaaagatgggattttaaactgttcctccatgcctcttagaatcccactggtggatttgatcaagttttagggaaaatgggatacaatatggggaacctatatctcttctctatggaaaggaggactcactggttctgggttctttcgggtccacccacagtcagctacagcttttccagctatccttagcctcttccaacttccaaaactttcttgagcagcaaatatgcactgtgcctttgacttttaaaatttgtgtgggtactagtcactggcttcttttgcaataagaatattaacaatgaatctcccctctctctctctacctccccctaccctgttcatattttttgagcctagttccatgtgcaacattcagtattggatgatctggattcagtacagaaagcctggacttttgagcctaaacaggatctgaagcagaaggatgaaaaacagatcaaccaacaacaagaatcaaccatcttggtttctcatttgtcaataatgggcaatagtcctgcccacatatcagggaatgtatatgccataattaaatactaatgcttctatcttctctagagaatttgttcctttatgtgaaaaatattatttcttcttaataagcaatgtatgacaattgaggaggcataaaaattagagaaaaataaaaaggaaaatgtctgtagttgcacattatatcataagtaatctgcattttattgtttttgtgatactctagaaatggatatgttttagtaaacctaatttaactcattaatccatctggaatttcctttgtaatattttataaaatgtgaatcgagactgataaatgttctaaatagtcaaatttgctaaaccttttataaactgttttcctttatatttacttttattttctcttttattatatatttcattcctgtatctattacctatatatgatatctatatctacctaattggggctatttccactaatgtgcccatatattcttgtaacagaatcacattatcttaagaatagtgacataaatattatttccctgatagggctacccatttccactatcataaaatctatttattttagaaaattggctttgtatcattagtctatattttctgatgaactttggaatccatcttatgctattcaacattgcaaagaatgattggaattgcattaatcccatttatttgagaaaaactgaggcatttgcaataatagtcaatctaattggaaacatactataattccctatgtattcaagtcttctctttatactatttaataaattatagtttatttttatataggttcaacataacactggttaagacttttttcaaggcagtatatcctttggtctctattgtacatttctttattttttttctaaatatataccattgacctatacaattttttggactgacattatatttgagtgagttattcaaaatatttataaatcatggtagttaatggttgaatcttttaagttattcttaaaaaagcatatcatctgcaaacaacttccatcattgtcctcctaatttgttgtatttttatttatctattttttttatttttttgagatggagtctcgctctgtcacccaggctggaatgcagtggcatgatcttggcccactgcgccctccacctcctggtttcaagcaattctccagtctcagcctcccgagtagctgtgactacaggcatgtgccaccacacccagctaattttttctgtatttttagtagagacggggtttcaccacattggctaggctggtatcaaactcctgacctcaggtgatctgtccacttcggcctcccaaagtgctgggattacaggtgtgagctaccatgactggccaatttgttttatatatgctgtgtttcttagcattccaaaatatatgttataaaattatggtaagaatgacttatgtgttttcctcatttgaatatgaattcctctaatattccattgttaattatgatattggatcttgattgaaaatagaattggaactctttattcttttttaattttttttaagagactagggttttattatgttgcccaggttggagtgcagtggatattttcatagctcactgcagcctcaaactcttaggctcatgcaatcctccacctcggcctcctgaatagttggaaatacaggtgcataccaccataccaggctcttcatcttattcagtgggcatgctgttattcctgattattttttgaagttgtcttgtgggacaactactatattttatccatgttttaaaatagaaaatgttcattttttattatatgacatggacacattatttatcaataatttccaaacatagttttgctttcctgagaacttgagacaatttctagttctcagctcctttgcttccagatgaagctatctctgtcctttcctatccctgtcattctcatgaagctaaagcagccagcagaaaactgttaggaccccaaaaaaatgtgcattcatcatccttttgtatagttggtgaacttggataaaatttctattaatacatttcttttagaagaaggcaggggcgggtcttttttttccccagcagttgtaataactactggaatccaaaagacccttggatgtgaacacatatatagcacacatagtgtgcctgaaattgttctgtgctctttactgacaccaattcacttattctgtataataaccataactatggccagtatcactagggccatgttactgatgaggacactgaaacacacggagaaattagttctcttacttgaggccacaaagtctgtcaacagggagtcagatttaaacccagtctgttggacttctgggttctatgctcttaactgtcacactctcctgattctccaactgacaatgagaattcattaaatcttatgagtagaagagtgacatgagcagacatggatttaaagagggcttagatggctcttgatatcaaaaaacctggcaacagtaaaataggagggatgtatactttactatcttcttcccccatcacaactttctagcaccctgaccgtaccatgccatttttggtaaaagctgtaatgtggtaaatttataatctgaatctagtagtcatgctcagttccaacagctcaataatcctaagtgctatggcagtgcttagtgaaggcaaagtgctggagagagagagacagccagtcactttatcagcaaatgttaaaagtttaaaaacacagagggaaaagggaaactaaagtgccatggcaataatagaatgaaacaaaatttatgtaaagctaccaataagtaggtgtttcatagctggtaataatttccaaagaaaagcaggagatgcttcattatttgtcttcaaaacgatactcttcagatttgtacaaagcttagaagataaggaaacaaatctgctgtgatccccagaggaggattcggataacacatttttctatttttaacttgtatgtcctaataaaatggcctctttgatgctcccctctcttcaatctaaacttttccacagagccctttccctgtctcattcctaataatttattaataagccaccacataaaaaagttccttaataaaacagttaggcactgtggacggcataatgtagttaatttaagcgggccactgaaatgcacataaatggccatatgagattaagagagagattagtactgctcctgccactctctgcagatggcagctgaatacgaagagctattcagatggcagcgttcaaacacctgtcctgagtttacatgcaataatatggtcaagaggcttctaaaaaccaaaattagaataatcttagatggaatcttgaataattcccatccccttctctctttctctatttatttcaatagcactcccaaccacacccccataccctctaccaccttctggtgcaggtccaggaactggagtatggctaactaatacgatgggaaaattgaaaaaaacaaacaaacctttatttctttcatggaaaaatatacaaacaagcaaacaaactgatacacactcatgctcatgtgtgcatgcacacacacacacacccacataaacacacacatgaaagatctcactcagctacttagaggcagaataacattggactgctattttttgcttaaacacgcattcagaaccactaagattggtaagccttttcaagcagaaaatatgataattgactctttggagtatatgttttaaaacgtttcaggcccatggaaattatatgaatatttttcatgtatcatacccatacttggcaaagccatcttgtgctctgcccagtcttcctatttgcagcattcttagtaggacaagggcaaagcattcatcccaggcaaatgcttatcttttctctgtttggcactaattctaatggcaatttaacaatataacaagtaatatcatctgacataacacaccatagaggcaaatactacattttgctaaaagtacaactaaacaacaaagcacagcttaacaaagctgactcatttgtcgagggttctgtactcaatctaatttgcatagttggtatttggcaactgtactcttctttcccaaattcaataatgttgccaaattggcagctttgcaatagctaaaggaaagattatatgcctatactctggtttcccctttcctctatgtaacaaactcaaatgttaaaccaataatcttctactaaaaacaatataaatatcaattcaaataattggtgaatagctgagtgaaccagccagacctgtgtatttttctgctggggtataatttctttgaaggaaagtaacaaagactaagaaggggctataaaccaaattgcttcagagacagagctgaaggagagggaggctcagaccatccacagtgggtctctcctgtggggatcatctccaccctccaagcttaccttctcccaccacagtgtcttcttttttgggcccttgtgattctcggcgtttggatgagatgtggatatgaatattttgattattagtctgggattcaggaatctcttcaggttttgtttctgtattaatggagaagaaaaaggatttttttgttcagttgtaagtgggaccatcagcatttaggtgtttcccttgtatgtacccttgtcccaaaattatcatacacatgcaacagaaagcatataacatattcagagttcaagaaataatggcataaaatcctatatactgaccaccaactttatggtataaaactgtactgtctgatacaaatagcagacacatgtggctactgatcacttaaaatgttactagttaaattgagatgtattgtaagtataatgtacacactcaattttgaaaaaaagtgtaaactaactaatgtttttatattcattacatgctggaataatattcttgatatattatgttaaatggctactagagaattacatatgtgccttgcatatgtggctcatgttatacttccgtaggacagaactgattagctagtgacagaatattactaatactttttttaacctttaattttgaaatgagtattgattcacaggcagttgtcaagaaatatacagggaggattcaagcatcttcacccagccttctccattgtcaacaacctgtgtaactacagtatgatatcaataccaaagaattgagaccggtacaagccaccatacgcaagatgaggagggcttttaatagaagattgtatatcttcagtctattcctggctgaagagatacttcatcttctattcatttatttaataaattcattcatctaaaatatatttacattcctcatgtcaggcactgtttaaggctctgggaataatacagtgagtaaaaaagatctgatccctaccctcactgagcttttattctagtttggatggcagaggacaaacaaataaatttgtaatatggcaaagtaatgccataacatggcatgaaaaggagatagttatgggtaggaaatagaccttttctttttctttttcaacttttattttaggttcagggggtacatgtacaggtttgttacaggtaaattgcatgtcactggggtttggtgtacaaatgatttcatcacccaagtagtgaacatagtaccaaataggcagtttttcaacccttacccccctcccaccttccccactcaagtagaccctagtctccattgttcctctctttgtgtccatgtgaacccagtgtttagctcccacttataagtgacaacatgcagtatttggttttctgttcctgcattaattcacttagtttagtgtcctccagccacatcaatgttgctgcaaaggatgcgatttcattctttttatggctgcattctattccatggtatatatgtatcacatttcctttatccagtacactgttgatgagcatctaggttgattccatgtctttgctattgtgaatagtgctgcaataaacattcaaatacatgtgtccttttggtagactgatttatattcttttgggtatatacccagtaatgggattactgagttgaaaacttctgttttaagttctttgagaaatctccaaactgttttgcatagtggctgaactaatttacattcccaccaacagtgtatcagcattcccttttctccacaacctcgccaacatctgttactgttttaactttttaataattgccattctgactggtgtgagatggtatcttattgtatactagacttcaaactatactacaaaggtacagtaaccaaaacagaatggcactggcaaaataatagagacatagaccaatggaacaggtgagagaactcaataatgaagctgcacacatacaaccatctcatcttcaacaaagccaacaataacaagcaattgtgaaaggactccttttcaataaatggtgctgggatagctggctagccatatgtagaagaatgaaacttgaccttttcctttcactatatgcaaaattccacttaagatagattaaagatttaaatgtaagacccaaaactgtaaaaaccgtagaaaaaaacctaagaaataccaatctggacataggccttggcaaagttttcatgtgaagtctccaaaagcaaatgcaacaaaaacataaataaaaaaagtgggaccgaattaaactaaagagcttcttcacagcaaaagaaactgtcaacagagtaaacaaacaacctacagaatgagagaaaacattcacaaactatgcatctgacaaaggcctaataccagaatctataagaacttaaatcaaaaatcaaaaaagcaaacaatcccatttaaaaaaaatgggcaaaggacgtgaacagacacttctcaaaagaagacatacatgtggccaaaagtatgtgaaaaaaatgctcatcatcactaatcattagagaaatgctagtaaaaaccacaaggtatacattttttggataggcatgatcaagaaggatataccctgaaataaaatcacagtaaaacaaaacaaaacaaaaaaccaagaagaagagaaaaaacaaaagccaattttacttaagaatatctttgataaagcactaaagaaaattaaattttatttaaaattcatatgtgattttcccaagaaaaagcaattttgcaattgaattttgagctgaactagctattttttcatggaacaccatttttacttgaaagagcttgaaataatgattgagaaattatggttattcatacttgtatatttggcagattttattttttctcaaatgaatgaagtgagcttctaaaacagaaacaacttacagtgtttgttcccagtgataaaattcaagctttcatgggaaacttggaatttgggaaaacttgtatcaactacatgagcttcacaggtttctaattcttaatgattcatgttattaacaaatgtgatctttttgaatagtagaatgaaatatgtcaacgttgagaagatcttcacgactccgtgaaacaatattttcaaaatgaccaaagcataatgcatggataaaagctccattcaaagtatatgatgagactggtggattttcatgtaacaaagtacaaaaaggccattgagatggcactttaagtaactacttcttgtcaagtctgggtgcagtaagaaagaagaatgtccactattatctgtaaaggctattaaaatgctcatcccttttctacaatgtatctgactgaggctggttttcttcatatacttcagcaaaaacaatacattgcaataggtcgaatgcagaagctgccaagagattccagctgcctattaaggaagatattaaagaggtttgtaagaatgccacactcttttcactacatattttttgaaaatacaactttttaatttaaaatgttatgtttacatgcaatgcatgtattattttaaaataagttaatgaataaatttaaaattttctgtttaaacttctaatttggaaatattaatggatatagaacccacatagacaaaagttgtttagattctcaacaattattgaaagcataacaaggtccttagacccaaattgaaaatgacaggcacagagagcatatagcttaaccagagaatctttttttatgagtaagttgtggaacaatatatttttctgattctgaagaaatgaaagttaattttagaaacttaataaatataaaatacagaaggtataaggaagaaaatacaaatcacttatacagatctgactactgtaaaactttcataaagttccttgcaatttctttacatcttttttgtttgtttaacatagttaggagtctgtgcccagtaaagaaaatatggggatatcatacaaggtaatgtgtccacagatattgaaaggttgaaagaggaaaaggaagacactgaagtaatagatatatttgtaaacacaggaagaagtcacgtctagagctgggggatcaaaagtggagatagcagagcttaggagttagaaaaagccttctctagagcttaggattaaaagtgaggttagaccttagggagagacccctgcatggctactaggtttagataccaaatggaagatgagaatcaaatcacctacttcacgggattacatgagataaaaatttatgaaaattctacttacaagcagacagcactacatacactgaatgtagatagaactttaagaaggaaaaacaaaaaactgcaaatcacagcaacataaggcagaacgaggtcaagatccccttcttcttcagaaagacaaggagctgccttgtagttagtccagtcctgatcaacaggatgaagagagaaacagggataccaggctgtagctcagttcaaatacagaaaatgtatccagtggagcctcctttcccaagcatctctcagagctccaagcccagcaaatgttgtagtagtgggactatgctacttcctctcacctttattttgacttttttctctttgcctctctttatttctcctcttttaaacttcactcttgcttttactttggttttgtagagcctcctagtaagacaagtatttctttcactcattggctggtctagggttgggggaatgggtggaataaggaatttgccaatgcctgatctgctcacctatctcctccactctaagatagaaagaagcttcatttacaaagcttctttccctcagtgactacaagtctccagctttaaaaaattaaaaaatggcatccacttctgggaaatatttaggaacctacttaattcctatgctaaaaaacaaacaaacaaacaaacaaactaagccctctccccttttaaaggagaagaggagaggatgacatttccccggattctttttttttttctttttttttttttttattgtgacagaatttcactcctgtcacccaggctggagtgcaatggcgcaatctcggctcactgcaacctccaccaccatctaggttcaagcaattctcctgcctcagcctcccgagtagctgggattacaggcatctgccaccatgcccagataatttttgtatttttagtagagacagggtttcaccatgttggccaggctggtctcgaaatcctaacctcaggtgatccacccacctctgcctcccaaagtgctggtttcccctgattctttaactcactttttgaagtgagttacaatatttttcacccacctcattgggttgttgtgtggattaaataaattcctttatctgaagtgctcagaatgtgttccatagtgagtatttagttaacatgagtttttattattattgctattattacttaagattaggcaatccttgtctctaatgtattaattgaacaatttggctttgtgtaattttatattttagagaagctcacaaaaatttgtctttggggaaagaaacagaatcattaatatgttatgtatgatgacttttttttcagaaattttcattccaaaataaaaaaaaaactacatacttctgcttttgcttcttttaagccaacagcacaccagacagctcagagccagccatgaggccacagaggacagggaagcagccaggatgatggtcgacttctccttcctagtcacaggcaagacagcaaatggcttggatcgagctgtaaaattgactcctgtggcggggaaaagaagatgtttcaatgatatgttaataagatgctaatataattaaaatatggtaaaaataaatacattcataatagtatctgggatatagtaggtgttcaatatatattcattaaatttaataaatacataaattataaatccaagatttatatttctagagaatcacaagattccaacaataacacataatagttatttccaattctgtcaattattgattgagaattcttccaattctctcttttaattttcagaccaaccttccataccaatgcaaaatttcagcttctttcactcatgtttcactaatgagaataaaaatattctcagctccagaatgtgtgaaattacttgctctgatgtatgtatctactcaatacgtgccatataacacatcaaaacaggggcatagggactcctgctgcagcaccatattgtcttagagagttatgttatctggaaaactaggactagaacaatggcagatagaactgccggccatgaatgatggggcaagatagcatcctgttgagagagttcaactctgtaagaattcatctgaaactcctcccatttatggagacagaaaaatttctcaccccattattatttatgaaatgagtcataaaataatctaaaaaagaaagttacctatctgcataaaaacacatacataaatgtttttagcagctctgtacattgcaaaacccaggaacaacccaaatgtccttgagcaggggaatggataaacaaactacagtttatctagacaatgaaaaactactcagccaaaaaagaaagaaaggaaagaaaaaggaaaagaaacaaacacacaattgataacctgtaacaactagaatgagcataaaaggcattatgctgagtaagggaagcccatctctgaatggtacacatttgtaggattccatttatataacactgtagaaaagacaaaactatagagttaaagaacagatcagtggttgccaacgatgaatggtggagaaaggctacatgtatgtgagaacagatttttggggtgatgaaatggtccttatcctgactgtggggatggttacatggatctatacatgtatttgaagtaataaaaccacatacaaaaatgtcaattttaaagtacattcattttaaaaataaattgtttgaaaacttgcctttaattttgggggtgatgaatatattcattattctaataatgaggatgctttcatgggagtaggcattcatcaaaatgtatcaaatggtatgctttaaatatgcttatcatgtgtcaatcatatctcaatacaaacaggtttatttaaaaaaaaaaaacttgtttatgaacagttacagccagcatttttaaagcagctcattcaaaacaaacaagcaaacttcaaacttctgctttcatccacataactcaggcaaaaagagtttttattttatgtactcaaggaaacaccatgtttttctttgctgtgctttcactgggctgaacctgacaattttactggaagtcacagtcagatcttcaatctcttgacttctggctgacttggtcccaaagctactacaacaaaatctcctctgtatacatcatgtatctgagccatatttggcttgtttgttatcaagtaattgctttttatgggcatctgaataagctcaatcaggcacagagatgggggaatagactttacttgggatttacagaagtaaaaactaaattcttcatacttttatccatttgtcaatgattgctcagtaattgtttactgggtcaagttgataagttaccagttcccattcttaagatatttacaagctagtaaataagatacacataacaaacatttgttaaacaaattaggatgtgacacatgccactagaataatgcaaatcaattgctttggatgtttattttccattgatatgattcgggaaagcatcctggaggaggaagtatctgaggggactctgaaggctgtgcaaatacataaacaaagacagagaggagaaaatagctattgatacttaggagacttacgcaggaaagtactggaacttaatgctagaagaatttgagacaaatctggatgggcattaaatatcaggcaaaaggcccttgagaacattctgaaggcatgaagtatcacagaagaaaagattcttttttatttttattttgttaatagagacagggtctagctctatcacccaaacttcagtacaatgagtggcacaattatagctcactgtagccctgaacaccagggctcatatgatcctcctgcttcagcctgccaggtggttgggactacaaccatgtgccaccatacctggctaattttttgttaatgtattgtagagatggggtattgctatgttttccaggctagtcttgaactcctggtctcaagtgatccttcagtctcagcctcccagagtgccagaattacaggcatgagccaccccgcacagcctagggggagattctaaactgagaagtgacatgagccacataaaatatagtcagtccatttttgtatagaacacaaaaatgacagagaagctaaagtcagggtgaccaggcgaaattatctaaatccaagggtggagaccactggctctcaattatcttagcatcagaacattttttaaaactgcaatcttaaaaataatctcaatatattcacttattcataaacaaatatttatttgtagctatgatgcaccaggcttttctacacccttgggatataatgtcaaactaagcagaatctctgtccctttggaactttggtctcaatggaggacccagcacacggacagtagacaaacaaataaatacatagatactataaagccagggagtgataagtgcataaagaaaactaaagtgagtttataagacacagtggctggaggtgtggggaggattggggatggtatagactgagtgatccaaaagagtcctctttgaggagatatttgagaagaaatctgaatgagctgagttagccacgtgactttctggggggagaatattccaaccaaggaattggcaaccacaggtagagtttctctggctaactgtatttgtggtgaaggtgggggggggcggggggccgggggcggatttgtgggtgatacctggttacattaatctcttctcagcagcagcccctgagggcctcctgagaaccccacggcaccaagaaatggtcataaaagccacagcctacaccatggtaatgatagtgaacgtggaaaggctagctacgaagtcagtactacaaacttacagaaacccttatctcttgacagtgtctcaggaagttgagaagtgataaatgagctggatttgataatatgtcagacctaagaggattccataaatacttgggcagatctattttctgtatttctaaaataggaataataatttgtttttctctctaaaatattggagagatgagggaaaatagtggaaatgattgcaaattctctgcttgattcatgaatgaatgaaacaacagaccaggcacggggactaatgcctataatgccagcatgagcccaggggtttaagaccagcctgggcagcatagtaagatcccatctctaccaaaaaataaaataaaataaaccaactgggtgtggtggcacacacgtctgtagtcccagctactttggaggctgaggtaggaggattgcttgagcctgggaggttgagactgcaatgagccatgattgagccactgcactccagcctgggtgttgggtgacagattgagaccctctctaaaaataacaacaacaacaacaaacacacacacacacacaaaacaacaaaagaaacaacaataacataaaacaatgcttatcagacctattattttgaagcctattagaaataagaaatttcattgtttggcgaaaatgtgtgaatatacgctgctttccccaacattctagcacttcaaattgatgtacttggaaacaaggagttactctctggacgtgtaccgttactcagtgtgatgtcaacaaggggtcacagaagtgcagatatttaatatttttcctttctttttatcctccatctattctctccaaatttaaacttttataaatctcattctgaaagagtctcacctaacagacttgatcttgaaaattaagaggaataatttagtgaaaaacactaagggaaaactttccaaatgattcttcagttagttctttttacaggctgtaagtagaaactacaataaagcagtagtctactaagtgtgaacaccaagaccagttcaaaatcacaggagttaccaagaagtttctgtctacaatacatttcgcatttggttttacaacctattccttaaaataaacttgataacgtatttggttagtcttaattaattactgaggtaattaaaggacaaaggccttttaaatgtcagacaaatctggaacaaaatatgcattcctgcctgtcttaccctttaagacatatccattcaaaaactcaagcttacagcacaatccctgggaattgggaatcccacggtcaaggacactacacgtttgttatgaacctgtacttatgttaggacactttgacacataaagtatgtgtaaattgctcttttaacaagtatttaagcaatcatcctctgaagtataaatgtgactctcatgaaaacatataatgagcacttgtcgacaggttatttatctcattaatgaagaaaccaggaagaacatgaaactggtttaaatagcatttaagagataatgatcatatagccagggagcaataatattatctgatctcagaagatagtctttttgttaaaaaaaaaaaaaatccaggctgggcgtggtgactgatgcctgtaatcccagcacttagggaggctgaggcaggcgaatcacgaggtcagaaattcgagaccagcctggccaacatggtgaaacctcatttctactaaaaatacaaaaattagccaggcttggtggcgcatgcctgtaatcccagtgactcaggaggctgaggcagaagaattgcttgaacctgggaggtggaggttgcagtgagccgagattgtgccactgcactccagcctgggtgacagagtgagattccatctcaaaaaaacaaaaaaaaatccaaaacttggaattaaaggaaaaatgattatgattacagatcttaccagtgtcatactggaacattttcaaaaggcccgttgaaagtttattaagttctctcaaacatatatttgtttcacttactatttattatttatttattaggacccagatatgtttatttgtagaagattgacatgctgaaacaatttttatatagttaaggatgcaaatgatatctgtaaacactggactatcaaaattttgcttttattgccctgtatccattgcaaacttatttcaacatttcttccctggctatacgatcactatctcccaaatgctcttttaattagttttcttatcttctgatttcctcattagtgagttaaataacatgttgacaaatgatcactatattttcatgagagtcacatttaatacgccagagggtgttttttttacatgttttgtcaaaaagaactggatcagatatgcaatttacataccccttattctgaagtgccaggatgttgatgggtattgtccccatttggcagggggttgaggaggacaggacccaaagttaaaatttcaacatcctatgactctctttcttataaattaacattctcctattaatatctaaccaaatgtcaggtaagtaaattaaagaaaaaaacaagtagaacactgaacgtaaacgtcaatgttgagaaggaaatgtacatttggtttcttgctcaccaggagtaacctgaggtttccatttctacatgtgctctttcttctcaagcttaatgatacagtcaagtgaatttattttctaaactatgatgacctcttattcatgatagtagctattcccactataagggagaaaggattatcttctcaaaaaaaaaaaaaaaaaacacagaataaaagcacactgtataaaattacctggaggagaagtgacagtaaaaataaagtgccagtttgacccagagatcaagactgccaagttgtagaagctaacataaccatcttgagtttctgcctgggtgcaccctacaaaaaagtacaaaacaaaaattagctgtttattatctaatctcgaacaatgtcttcatgtcttctgcgaaggcagacatttggacaataaaggacaattttttaaactcaaagaggttacctaatccatcaggttcttcttagtcaagacttagaaccaaatgacccaagacagaataacagttaacatatattgaaagttccactatgccagacactgttctatatatacacgattgcctacaaactacacaacaaccctataaaatacgctattatctatattctagcaattaggaaataggctcatgaaagattaaattatgtggtactggggttacagcccaaatctacctgatttcagtctgcattcttaaccactacaatatattggctatattattattaaatgtataatatataaagaaagaaattctattatctttctaggtggtcagtttctacagtctgtctttcttctatccaagttatctatagtttatgtggtaccagaattaggccaagagatcaggaccatggcaatctaccaaataatgactgatagagctactctgatttagcaacttgaattgcctgagccttggcttccctaactaaaatgaaaaaaacaaaaacaaaaacaaaaaaaaacccttgcgtcttctaacagtaggtcatccatttataacgtgaaaaaaggcagcttaactcagtatcacattcacaataccattaatcgtcttttgactccaccatccctaaattattttcctaattaacagctgctagactttactctggaaatgtcaatatgattggcatggtggacaaagggttatgaaagtggtctgaaagtttatagattggtttgagatctctaaggctgaaatgtgtcataaagatacaatatgcttagtgttacatttttcaattcaattgcttaatctttttgtgaaaacactgtctttcttcatcaattttgcagagctaactaaaacttcttttttgagaaagatcttttgcttcatctcttctgagttctaaaataaataaaatgcccagtaaaatgaaaataaataagccaagactcaaataaatgataggtgcccaagataaatgcagtttatactctttaaaacctatatgcatcaaaattatggtcaataaactcttgcaaacaatgaactgaagagtacagatgttcaacatgaaatcatttgctgcagtttttcctttgacaaacgtctttattgttcccatctttggaagaatacaaagcagcatttaatcgaaatgtgtccgtagagcacagtgagttggcctcgtagaacagccgccaaattgcctaatggaaagtgctttagttctaaatgggtttgcttttgcgttaaataccagcttgccttagagatctctacaaagattcccatatatatctatgatattctcagatttgaagcatatgtgctcaaaagctgaggcagttgctgctaagtatagtacattactccagggttcatcatatcttcagaatagctatgatgacatatacaaatgcaattgacaggctccctgatcatgctggtataaacagtatactggctgggggacttgggatggggtggggtgctgggctcgagcaactttggaattgattacacaactaccagggaatgatacctgaatgggtttctgcaggatagatagtttctaaaatacctttgcagcccaaattatccccacagctatcccactcactcctaggtatgcatactagcaaactgttacattgttaatgttgagatgttatctttaaaagtattaaggacttttttgtgcaactatgatccataaatgtcaaaggatattgaagacctgtaaataattgtccttgagtatataaattcactttttatgataataggttgtaactgccttttcactgaggagggtctactaaagaaaaaagaatatgaagttaaattgcagaacaaaagatttagaggagatatatagatatggttttgttgttgttattttgtttttctccaggagatacttatagtaagttagataatccatcccaaatgcttttggtgcattctttctgaagtgaaaaagtagtatttcatgatggcttcaagagaaactttcaatcacataaaatagggtagtttggtgacatgggtatgctaaaaacagaaaactgcatgtgatttcttccctacttcatgactcactcacataaaaaaggtgtgtatataagacaccctcaaactagtcctcacacattcccattggatctcttaaaaaaggtaatagtgacaatactgatccaagtgagctagttggcttgagtgtggcttggtgtccgtagaataaaagagtaaatggtatctcatctcacaccagttagaatggcaatcattaaaaagtcaggaaacaacatatgtggagaaatagtaatccttttacactgttggtgggagtgtaaattagttcaaccattgtggaagacagtgtggtgattcctcaaggatctagaaccagaaataccatttgacccagcaatcccattactgggtatatatccaaagcattataaatcatgctactataaagacacatgcacatgtatgtttattgcagcacactcacaatagcaaagacttggaatcaacacaaatgcccatcaatgatagactggataaagaaaatgtggcacatatacactacggaatactatgcagccataaaaaagaattagttaatgtcctttgcagggacatggatgaagctggaaaccatcattctcagcaaactaacacaggaacagaaaaccaaacatagcatgttctcacataggagaagtgggagttgaacaatgagaacatatgggcacagggaggggaacatcacacactagggcctgtcagggagtggggagcaaggggagggatagcattaggagaaataactaatgtagatgacgggttgatgggtgcagcaaaccaccatggcacatgtatacctatgtaacaaacctgcatgttctgcacatgtatcccagaacttaaagtataataataaataaataaatagataaataaataaagagtaaatggtttcatgcctcattcacttttcatggccacaacatgattctaagctggccgggcatgacatccttaaggttactgaaagaaaaataatgaaagatgaggtgcaataagtgtcaggacaaagtaaaatataaagtctcagtaaggtatcatataggagaaggtatggggaataggtaaggcatggagcataagtaaggtactgggtataaataatgtgcaaagtgtggcaaggtacagaatataagtaagtaagatatggactatgggttagaaatgaagtgtgagtaagggtctggagaatgtgtaaagtatggaatatgagtaaggtacagactatgggtaaagtatggagtgtgaataaggcatggagtatgtgtaagttgtggaatatggctaaggcatagaatatgagtaaggtattggacatggtaatgtatgaagtatggcaaggtaagggatataagtaagggatgggctgggcacggtggctcacacctgtaatcccgacactttgggaggccaatacgggaggatcacctgaggtcaggatttcgagaccagcttggccaacacggcaaaaccccgtctttactaaaaatagaaaaattagccaggtgtggtggtgggcacctgtaatcccagctactcaggaggctaagacaggagaatcacttgaacccgggaggcagaggttgcagtgagacaagatcgtgccactgcattccagcctgggtaacagagccaggctctgcctcaaaaaaaagtaaggtatggactatacatagggtatggagtataagtagggtcttaggtatggataaggtctggaggagcaatgtaaggcatgagtatgggtatggtttggagtatgggtaaggaatagaatatgggtaacacatggagtagacaatggggaggtgagttccagtagtcatgtgagagtatctgtggtaaatattaccagaacatgaaaaaagctaaaaattaatatttctatgctgctgtattaagatcagaaggtgagtgactgttacatatcctaagcactttctataccaaaacaccaacagtagcaaaatggcactgaaaaatgaacagaatgacagcatcaaaacaggcagttcgaaatgcaattctgaatctttcatcttcacagtgggcaaccttggataaattcacttcattttcttactttcttaatgacatgccttgtgtctacaaatctgtacaaggaccattctggtttgtcctcattccttgggattttaaacccaagaagcttctaactgaactgcccacattaaaaaaataaaaaaaaaaatgaccaggagcaacaatatgagttacccacacaggtgttactttcaacaaattgaacaaaagatagattgtgtaagtagaagggaaagtctggagagtctatgggcagattctgacaaaatatgccacattacctgggcctttaaatttggattgtataaagagaacgtggagagggtactgaggagagcaagacctcaaagtttggtagaaaattatttttgtggacatgctgaaaacatttagagtctcgttttgttttgttttttgtttgttttaattattttattttattttaaattccgggatacatgtacagaacatgcaggtttgttacgtaggcaaacatgcgccgtggtggttggctgcacctatcaactcatcacctaggtattaagccccacatgcattagctattcatcctgatgctctccttcccccttagtcctccccccaatctctgacaggccccagtgtgtgttgttccctgtgtccatgtgttctcactggaaaacatttggtgtcttaataagtaattagatgggttaaaaaaaataacaggtcaaaatagtagaaagtcaaattgaaaagagagtgggaaaatttattgttctaataaaacaataagacgaagcaagctttaaaaagtaagggttttgaagctatgaactgtttaatcacgagatgtcaatcgcctccttaagagaatttttagaaggggataatttcattttctggaatcgatgaggtgcagctttgccagaaacaaaatgtataagctaaattaaatggtgacattaaaaaaaaactgagatctgagattaattcattgaaaacaacatcaaatgattattcattaacttggagactttattacaacaattttatatgtttcttaagagacaaataacaaaaaattaaggaacaatgtcatcagaaatggtaggcaatgtgcaccatatgataggaacagttttaggccaataataaacgcaattagaagacgaggcacgtctatgattgacttatggctatccatttgaacattccatatattttatgggaaccatctgaatgagcttagactcatagccagagtagagcaagaaataactgtaaaatcatggcctattcttggaagtcagtgattttgcaggtaggctgatgtttgagctggcacatgagtcatttctaagcctgaaaaaaacattttggacaacacaaaacccacagaaatgccctacctgattcatgaggtgcacaggaaattggataagctgattttgttttgttttgagctggagtctcactctgtcaccaggctggaatgcagtgggcgatcttggctcactgcaacctccacctcccgggttcaagcaattctcctgcctcagcctcctgagtagctgggacttcaggtgcatgccatcatgtctacctaattttcgtattattagtagagacggggttttaccatgttggccaggatggtcttgatctcttgaccttgtgatctgcccgccttggcctcccaaagtgctggcattacaggcatgtgtcactgagcccggccaataaaccgaatttttaaagagtggtaaacacatcctcaaatttgcataagaatggagatatttggccaattataaaaaggtacatatacaccatatcaatttataattttcagtgatttattggtatgaaacttcctttcaatatgttactggctaatctcaaagaatgtttcattataattacaatactaactgcattaaaagccagtgcttgaaatcacacttctagaaagaagaatttgcaaaagttaacaagatttcctacttattcccctattataatatacaaatatcaaggtaataatagataattgtgcttaaaacaaataacctttattttcttttttaaaaaatttttaccagtactgatatatatctctttgtatagtatgcatattttgaaaacattattttcttttttctttttttcttgagacggagtcttgctctgtcacccaggctagagtgcagtggcgccatcttggctcaccgcaacctctgcctcctgggttcaagtgattctcgtgcctccgcttcccaagtagctgggattacaggcgcatgcccaccatgcccggctaatttttgcatttttagtagagacggcgtttcaccatgttggccaggctggtctcaaatgcctgacctcaagtgatccagccaccttagcctcccaaagtgctggattacaggcacgaaccgccgttcccagcctgaaaacattattttcaagtcacatttgaaatcacaaagaatttataaattatttctcatctaaaatagcaacacaatatttagtgcagagatttgcttgagtcctagctcttggtcagaattattcaacaattctgaattcaaggagtcaagataaacccattggctctattcttttactgggaccctgcaaggatttttgaaaactgtctgacatagaagttgtggggaagggagtgaatgctttcctttctgaggatattttccatctaccttaaaaatcatttttaatccatttgaattcttgggacactttttaaattttctcattgaaactagtgggagagattaaagaaatttaacagattcactttttcagactgttgtaatctccagctccctatccaaatataggagatgatttttaaatgttccatcgaacccttctattctaggttatatcaggttgacataaaatgaatttctcttcacctcaaggtgaagcccagaattggactgtgatattgtgcatgattgggactccctccgatgagaaggaaatacacaatcctacccataagcagaggaagaatttcaaggtgctgtgataattgtgaggccccttgtgcagagaggaaacccctatgcatgaagagtttgaggctgtcaggcaagatctgtgtgttgggagattgactgcacacaatagggagaaggctcctggtaggaagcatgattaataatttatgggttatgttggagggaggcaggtaagaagaaaaaaactcttgtgacacccagaacacaaactatattaattgtaaaacacaacctcttgctcttactgccttaaaactgaaatcaaaagggcctacgtcttaatttggcccagcaaccaggttgtacttaccttttcatgtttctcatcataaaaactcttgctttttgctcccaatccagtcttccccatttcagtaaataacaccaatatccacccaatataacaagatcaaaacctataagttgtccttaagtccttgttttctttactcctagtagattctgctgattcaacttctaaaagacattctgaatcaatccagttgtgatctccaccatcccttgcctggccttttgcaatcactttccaactggctcaggaggttcactcttgccattctccaatccaccctccatagagcagagtggtcctctaaacatgcgagtcagaccttggaactggcctgcttaaaaccctccaatggctctgcatctcactgagagcgcagcccaaactccccaccatggtccccagagtcctctgttgactgtctggctccagcacctgtctcacttttcctcttcccttgatctcccttagttatgaggctcctttgccttaattctgtttctcaaacacattctccttaacatattttctgtggataatatattgtactgtttgacaacataaaaatacaatgattgaacaatttcgtaataaattaatatgtgtctcttttgtctctttgagtaggttgtatttcaacggttttgtgtgtgagagggttaaataggaacttagaactcagaaactatttttcccataaaaatcatgttacacctgcttgcttctctctagaccaggccctaaaatgcacattattgggtccttctgcagaatatgttgccaaactatcttgggcctagtagaaatctgcattttaaatagattttcatataaatgagcttcaaggaaagtaagtggagctggcagtggtgctgggatagaacaggaagacaaaagagggtagacaaacataaggagaaaaactagctaagggctgctatgggtcaggtgcttttgcacttatcatcacatttattcttcataccactgagagcaagtctttctatttccccatagaaatcatattgtacttggtaaattgctccctggcccagtccatgatactataccaaacaagggtgtgtcgtgggggcactgagtggactgtagaaaacctaggatttgatgctcacccaaagatgccaggcacttttccttacactaccttaaggatacggataagttggaaaggttgctttattgtgaaagggaagggagagaaaaagtggtgactttaggatttgctgccagcctaatcttccttttcacagacactgacactgtagattagggatgaaggagtttcttcccaaattactgaagaaattcagtattaccaattttgctatgaattcctaatggctgcaaacattttctgtgcagataaagtggtaacagatatctgaaatttacagatactttacctaccttttagcactgagtctgatgctccttccagggaagctgaaattgtccatggctctgaaggaggtcccagggactctactcttcgattctagaaatgggaataggaggagggaggaagaaaaagttggattcagaagagaattttgtgaagttagaaaagatggatcagatatttgcttttataaagcatatattcagtagaaataaaggaaagaaagtgataaataaatgtctttctcatgttaagaatatatcagaattaacttattgtaagaagagtgaggaaattattgcaagacaagttggggcaggacagtgaggagaggaaaggaaaactatgtttatagaaaagaatggtactatgtgctgaaggttcttaagaaaggaaaggtaaagagaagaaaacaggagagagctgggtgagtgccagaccacatcaaagttgacaggttttcaagtgtggacctcagtgccacagatttctctctgcaaacatgtcaggggatgcatttataaacaggagaaagccaattcaacaatcatagttcactgtgaattttgtaaatactgaaaagataaaatagaatcaggacacaaagactgaaattagaattaagcacagaaacttcttgttttacttaatcacatataagagagattattttaaaaaacgtaaaactgtaatgtatctataatgtcataagttccttcactagcatgtgaaaaacttcttcagatatagatctacttctttgtgaaggctagatttcagagaagatgtgacagatctacttcaagaatttggttggggaggaaaagtatcagaattttatttttacccttgatcaaattctgaatgttcagagaaaatagaaggcaggcaggctgtgaagtggaaggaaaatgtgaaagtagtgagaagctctaagtgcaacaaattgcacccagtgggcactctgtaaatgtgtatcaatgatgacacactctaaaagataggctgaatgctacatgctacttagctctaaagacagatttgttacctgtgaaaagttacctgctcatccaaaaataccaattgtggctgcactggaagctcatttcccacttctccatctgaaggctggactaggatggaaagtgcatagggccgaatatatatcaagttcccagttttaaaactgcttgtatttctgacagatataaaaacaaacaaaatacatccttaggattacacatatccctatggtagcaattttccacaatccattattaccagtgaaaatatttgcatttgcctgtgtttctagaaaataatacattgtgtagtgaacatggctttatagcaaaggttaattgtgtatgtatttgatatgttttcttagctataatgaaaatggactagggggtagggaaaatcacaaattatgagcatatatttttatcatcatttattaaaatcagccaaaaaataaaagcctcagtgaaaattagcctcagactaatatagataataataataaaagcctcagactaaaatgacaggacatggacacgtccaatagtaagctattaaatcagcttcccaaataatgccctgatttgtggatgtgttccaattctgtgatataaataccaccaacatagctaattctgagatgacaagataatatcactgagcagagctgggaagagatgcccaacagcaaactccagtacaccactgtttacacagaatagctcatttaatcttcacaacaagccatatttatattttccgagtgtgtttgtactaaatggattcaataactattaatagcattaatgaattaatttacttcagttgcatgaagcatctgaggagaataatatttagaattgatatttactgagcacatactatataccaagttccatgataaagtgttcatatataaattcattgcatctttaaaatgacactatgtggtaggtactcttatttatatatgaagaaactgaggtccaaaaaggcttaaataacttgccaaaggtcctacaaatagtaagtgttgaccaagatctagagtggttaaccaatgacctatattacttcttagttcctttgaacatgttaagtgctgacatgacttagcaacaaaatggaatacatagaaaatagttacataattcatgacagtgtaaaacatatttcactcagagtttcggtatttttgatgacagagcctgcttcattaaaataaaattatatacctattgtcccattaagcctattgtgaattacatatcataggcatgcaacagatgtttggcaactaaatgcagacacctggacatcacatatatatgggaccctgacatagagcaacccttggtgagttatcctcaatagcctaggccaggtctcatgaggtatttatttatttatttatttttaaagtagcctactttgctttctcccattaaatgtaagtcaactattctatttcctaaccacctccccttccccacgtgaggaggaaaggataaagtatttatttaatatggagggtgcatgtcaggaaaaagtgaagatttgttctgaaagaggaaatagtggaagagcaaatacaatggatcactaaatatgaagtttccataggaagcaattttcttctcccctgggaatcctaggaaatgcgggcagagtgcaaacatgtggtcctaagaagctctttagtcatctaccagctaagaccctggctttttggctggaatcactccctgggaattcaactcacactagccccatcatcatttcttagtttgtttagcctgagtggctagggcttctttccttttttaaagggaacaatttaaaccagattttttaaatccatgctattaattctatccttctgtgggttccaggttattagaaaattctaatgttgttatcagatcctatttctcccctaaccttttccttaaattctttctgataggggctaggatgcaggcaagcagtctgggttaaagagactgaaagaccccatcaaagattctcacataagtacattgacgtcttgagacgaagagagggaaaccaactgcctgaacacccgctaaaaggtccattcctgacacactttaaagtttattgtgagcaaacatctcttgttaaatgtaaacagcatctcactggaggtcacagacttgctgctgcagcatatcccaaggtaataccactttaagctccacataaactcttaagcagtttctatcctaaaacctgaccgtaggtggtactgttttttacgatatgttataatagtgcaataaatctgttagcttaaaatcgaatctccgtggccttttagagaaatcatcattaaatgcagggtcctgttaatgatgccatcgaagtgaaattgtttaatctgctaagggggtgaaaggtcatcaaatgaattttttataatacatcaacttgacacgcaatagggaaaactgtaatagataaaagcaaaggaaaagggcactgtcttcttctgataggtcaatagcagccaagagagtcactcatccactttcctttcatgatgggctccttttgcatttaatatggacacccaattaatacctcagcaccacagacaacctcattttaggtgacttatagcaatttctcccccttccctgaaatgaaagtgatcacaatacatcatagcattgtgcgaattaacgttaattgattcaagttaccaagcaatgatgggccacttatataatctaggcgttattgggtgctagaagggatggagggaagattagattccagtgtccgttgctgtgacgacgggagtcacctgatgccttgttagacagttgtaaggttctattgctggccccagtggggtcgtcagtaaactggagtgatgtccaaacatcattacatgctgctccaatattaaagcaaagggattagcaacttattgcaagcaacctggatttgtcattgtgctgtcgttatccaatttccaactgctaatgtgactgtagcctgcaggcagaaggacctacagccaaactttaaaaaatgggggagaaaagttccctccattcatcccagtttttaccattatttaatagcttccaatacccagttaggtatgtgagagatttttttttctgcaatgcttaaatgcaggctataggagaaaagtcaagaaaatacagaaatttcccaattaagagatcactcctattcatgtcattattcttgcttttcgattccaccagatctgaaatgtttaccctgtagaagatggaattatttctatttgcatggaaaactcagaaagcaagtaagttttattagtgaaaactggctctcaacaagacctactgtggtggggtgaggtgaagttggggtggaaatcagagatactctctcttcaaccttcttctcaaagctactaagccgagttcctataaaaagcctcatgttttgattgaatgcttcatgatgtcctgagcattttttatctctcttgttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatctctcttgttttaaataggctagataaggccaaatattctatatgtgccacaaggggacttgaaatataaaatgattttggacaattttgtactctgaaagaaaaaagtaaattctttagtcaattctaaagaattctaaattaaatatattatgtttatatacagggaaaatgcaaatctaatatcaacatatttctatatagttaacaagtatatgttaacccttctactatgtacaaatgttgttcaaggcactgtgagatatgcaaagatatagaacactgtgatctctccccctcaagaataaccttctgtatactttgtatgacaagaatgacttttctggttatccttctgagttgatagatacaattttcttacctttcatggtcctgatgctcccttttaagcctatctaggctttcttagcaaatagccaattcctaagagggaagaaatgtcttatgatctgacggtttttttctggcactgtggtctagtagttccaagcctggcatgttgtaagcacccagtacatgttgttatagtaacacttgccaaatcagtacctactatgcatcccctctgttcttaggtcactaattgcctctgaaaaactaccactcatctttgccttcaacttcacattctggggcactcctcaagcagtgtgcttacttctattctgtgatacttctgattaaactcttgtgattccatggaattattcatttaaaaatgagattccagtaaccttaggtataacttgcagtggatcagaagtatataaagacacagaataaacacggtacatcttccaacaattcaggggacaactacacctcttaggagttgactagctgttaagtaagcctaggtgggtttaacagggcacaaggacaatgaaagataagtaaaatcaattataagcaaaaatcaggggacaaaaacctaagtattttaattggtaaatcatttaaaacaagattttataataaatctagcatgagtattttatctaggagaatgaaaactctgcatttttaaagaccatacgcaaaataatcaaattttcctgtttagcctggggagctgtagcagtcataagtctgtacaggaaaacagaaatcactcaaggtctttctaatggaagagatttaattcaagatattggttgcacaggagttttagaatagtagaaaagtaaaacaggctacctttcactgtatgtgatatattgaatgataatttattgtgatttacaatgtgcttaggcacacttgagaatataatcataagtcgaaaccttgaccacctaataaattttataaagattaacattttatactcaagttaatgttacaaaaaactggattaatggctaagcagcttcatagagaattaatgatttatttgtaatagatacggaatgagatttagtataacatcttctcattaaatagttgaataaatgttgtttttcatatccattaattttcaaatctctagattcttatagggaccatatgatattttgaacataatagctgttcggttaacactggggaataaaaaacattggcatgtaagctttcaagagtctattatatttacctatgagttcactatgtgtacaaataattcttaaattaattgattttaagttagtgtcgtctgattttggacttagaacttttctggatgtggatatgtcaacagcaacaatagattacaattagcatccttttcatagcaaaatagcaaaaaaaaaaatacaatagattacaattagcatccttttcacagcaaaatagcagaaaaaatacaaaccgcaggacaagaactaaagatttagtggtctggcaccattcagtatacgaaaaatagtacccaagggcatcacagcaaaaacaggattgtgaagtaaatgacagatttaatgatgaccatgaatcgtcataacaaatgtgaacagtctacattatttcccattgaataagcctgggtattatgcaatctttgtctttttttaacgattaagagttgaagactttttaaaatgcttgttattaatggaacaatttttaattgtatggaaagcttgcttacgtagaacatctcactttcccacaaagccacacatatgaaataagattacaataattttgccatcgacccaattaaacaaagtagtgaatttgtactgtagtgaaaagaagaaatgatgtaaaaacactctttaatggcaaagttgtgatttttgtcatagggaagaaaagagacaagctggcaatataggaatctcttctaggatgaacattctgccggtctggaaaagaacatacttccttgctgatagaaagattctactctttcatgctccaaacagctctcttctagaaagcaggtgcccaggatacataaagaggagaagatgcagaagagaaaatgctaaaggtgactgaatgccaaaagacttgtataattgattggctttcctggttttcttctctattccaaagcaacctgatagggtgctccttatgcagaatgggggaacttaaaaagctactaatatgataagtatatacacattgcacacacccagacacacactcccacagtgtcatgctcaccctcacagtaactgttttcatggcccaaaattcatggcaatgtcacaaacaaagagctttatgtgatatgccatattactttctattgctgtataacaaattaccacagtcagtggcttacagtaacacaaatgtgttatctccagggagtgggccaggagtccagacaggcttggctgggtttactgaagagttcacttccaaacaggttgttggaagaatgcatttcctatgactacagaattgaggtccctgaaaaaccacaatgagatactatctcatgccagtcagaaaggcaattattaaaaagtcaggaaataacagatgctggtgagcctgtggagaaataggaacacttttacactgttggtgggagtgtaaattagttcaaccattgtggaagagagtgtggcgattcctcaaggatctagaacaagaaataccatttgactcagcaatcccactactggggatatacccaaaggattatttataaatcattctactataaagacacatgcacacatatgtttattgcagcactattcacaatagcaaagacttggaaccaacccaaatgcccatcaatgatagactggataaagaaatgtggcacatatacaccatggaatgctatgcagtcataaaaaagaatcagttcatgccctttgcagagacaaggacaaagctggaagccatcattctcagcaaactaacacaggaacagaaaaccaaacaccgcatgttctcactcataagtgggagttgaataatgacaatacatggacacagtgaggggaacatcacacaccggggcctgttgacgggtggggagcaagggaagggagagcattaggacaaatacctaacgcatgtggggctgaaaacctagatggcaggttgataggtgcagcaaaccaccatgccacatgcaagaagacaacaaatgacaacagagatcaacaaagttttggaagttggaaaacatggtgatggaaacttagctaagcagaggatgcttgaatccagatgcctctagagaaagaccagaagaggctagttcactgtgtattatttactttaaaagtagatggctactccgtttcttcccacaaaacagagttggtagcttatagcttttctttctttttttttttttttaagacagtatctggctctgtcacccaggctggtgtgtagtggcataatctcagctcattgcaacctctctctcccaggctaaaacaatccacctcagccttccaagtagctgggactacaggcatgcaccatcacatccagctaatttttgtgtttttgtagagacggggtttcaccatgttgcctaggctggtctcaaactcctgcgctcaagctatccacctacctccacctcccaaagtgctgagattacaggtgtgagccatcacgcctggcccaaagttggtagcttttgaaagtagctagtactctcttagaaaaatgtgtccagtatggcctgaatttgttgaaatgcatataagctcattaaattaacgagagcaaaccactggagaacatccttggtacttttccatgaaaaaacttaaagtataataataataaaaaaaaaaaaaagaaagaactgcattcctagactcatttctgctggcttaaggtcagttcatgggctcgtcaatggctctccagtgagttcaatggaagacccaactgactgtgatcaaagctgaaagaaacaaggctggctctggagactgtgtcgggctttagggttttgtttcattttggtttggttttttatcatactgtgcaacactagaaaacatgagaaaccttgctaattctcattgaatgccataggatatggcatttcttattcgggagaaatttgttcagacatacttaagaagcagcccttctttatcttcagaagatttactctttgccttatgtctagaaaatgtcttttaaaatgctaaagaaaaagagagagagataggcggatagaacacattccaacacaaaatcaatgctatattatacactttgaactgtttcttattaaatcagaaataactgagtcaaaagtaaaaaaacatgatggctatgacaaatggtgggtgataaataaaagtgatcttttctctgaagctgtttcacttcctcatgatagaatggcatgccccacatatatgtgtgtatatatctaaacttgtgctggatccactctctgctggttttcttctgatgtacctctattgcttctactcattgacttttctctgtttctagttaaaagcacaatattaactgagtcgtcttttatatataatataaaatcagtcattttggaattacgacctattagaaagctcagtactgtaaaatctaaataaaattaagcaataaactgactctctttctctctagacaaaaattattcatgtatgtatacttataatatacttacaagaactcagtgggatctaaataaaattgggcaaaaggaaagatatttcaatgtaagctaagatgcatcagcatcatttctttaagcattctaattctcataccaccatacacaatattataataatgtcactaacatggtgaaggtttggtagttgacaaaaatatccaaaactgaataaattttgaataataataagctatgagtaccttttaattttaagttaacaattcccaaaggccttaaatcaaccagatccagaaaaatttgcttgcattttttctcatcctctttatatatcaatgtataacaggaaagaggaacatccatctctattataaacacaaaaacactagctaaactttcacttggatatgttgctctgtgtacaaaaagacaatcaatgtattagctgaatatttctccaagtgtgaggacgtggttttctttttagttttgctttttatttaagttctaccaaattccacattcactggagatggttgtatagaagtagtcactacccattaaatactaatagcttattagcactatcacaaataaaatgatatagcagtagcaacagaataacatctatttcactttaccaaccctagaacctagcccattgcttaaattcattaaataaataaataaacaatcaaatgaactaaaaacaagttgcttcaaaaatatctcttcctacatgcttttcaccttaaggaatcaaaatataatgttttctaccaccttggaaatagaataatcatgaaaaacatgaatttaatatagaatctaaaaactaagaatttaagtctttaaatgactctttgaatttttattcttatcttaaaaagcagatgagttatatgattcagtgtaagtagattgacatttgcaacatatgtcaatatggacctaaaaaatcagccctcatttggatgtgaatataattagtacttacccatagccaatgactccctttgactgagtaactagtaaggccccgatagtcatattcagaacattctctagtaccccagtctgttgagcagtgatgactcgatgagccaaattctgtaatttgttacttgataaggatgaaatcattccagtgctccttactgttggcgaatcaccaatttcaatgacaatcacttttgagatagtttccacagtcattgggggtgaagccctatgtgagttcatttccatcatgagaggcctacgttgaccaactcttctataatgactagtgcaagtcacagtagggcaattgcgctttctttttgctctactgtcagcaatggcctttaaggtctcttcatggccaggcatctcgtgaataaacctgatttggttttggccaatctgtaagaagttagttagtctttcgagtattactatttcccagcctttttctaagactgaaaccatcacagtgagggccaagtgaatggaaacacctgagcgtatttcaatgggctcctctccttgtaggacaacatacaagaggttatccatgatgttgaaatagttggcaccaatagattcattcagcaataaggaagctgactgaaccagagtgggtggaataaaactttcccctaagaagacgtgggggctctggagctcatggtagaatacagccaagagaagcttggaggtacttttgttccccaatagaaaaaagcgcaaaacttgaggagtttgatccatgaagcagactttggtgatttgcctgatgggtaagatagaatagaaagtagacactgacccagaagtagagcagggaatattggcatttacactgctaaagacatcaacaaaaccactagtcacagatacaactggatataacttctgaattgcccaaatggcatcagcgctatcaagaattaggaccacttggtcagtctgtttgcagatgaatccttgcatcagaaattggtatgtacatttctgttcttctctaaatgtacctataaaagaaaagaagcaaaacaagtgatatatgaattataatctgtcaatgattatttgtaatccatcactcttgccatcatctataactggataaaatatttattaaacatctaattgtgccagatactgagagtgcaaggaagattgcggcaaaatatttttaaaaattaaataatagttctttaatatattttaaaagtatatgttacataatatgttatttaaagttaataatggagataataactgagaaaaggagttgaagaagtaaaagaatcaagacaatgaaataatcattaagggcccttgagagaaaagcaagataaactgctttttactactctcacacactccatataacacaaaatacctcacctctggtcaccaaaatgtgtaggtatttcaccacaccagcaaccaattctccagtggatacaaactgggtgtcacataatttaaccaaattctgatactaaacaaagttagtgcagactccacaaggtaagggctcagtcttacaagcatgcccctatttcagatgccaattgcaagtcctaggctgtgacctctgcttctgaacaactggctatataaatcagggctctcaggactccatccttgaattcaattaactcgctagagaggcttacaaaactcagggaaacatttacttatgttttttcatttattataaaggatattacaaaagacgcagatgaacagacagatggaagagacgcataggacaaggcatgtgggaagggcatggagcttccatgccctctgcatgtgccaccctcaagacacttccatgcgttcagccacctgaaagctctcccaatcctgtcctttcagcctttcatggaggctccattatgtaggtatgattgactaagttattggttgttggtgatcgactcaaccttcagactctctcccttcccctgaaatggggatggtgaggagatgaggcttgatgttccaaccctctagtcacgtgattggttcccctggcaaccagcctccatcctgaggctatccagtagttgaggcattagctcattagaaaaaaaagatattcctatcacccaggaaattccaagggatttaggaactgtgtatccaatgtttctgtcacttagggaattacaaatatcttagggcttctgtgtcagcaaccagagtcaaagatcaaatattcgaacaaaagagtctcctagcactactgattttagtagctctgcctcaggaaccagaaatatagatacagatatagattagatatagatatagatatatagatatagatacagatttagatagatatagatatagaaagaatctcacaatatcatagctccataatagaaatagggtataagagaaggggtagtaacatccaagcgaatgggagaagaggtagatggaggggaatgggtggaacagagaaattatgaaggcatattaaaattgaagaggtgtgtctgaccagattgtgaaagagtttggatgtcaaactatataattttctcatactctatttttccctaaacataaaaagtaaagaaatacaagaagaaggaaagaagaaagtagtaacttcggaagttgttgatattaaagagtccaagttgaggatggtgagggttaataaaacatttaaaggaacagcgttattcattatttctaccattcctaatacctcctatatgaacccagaatagttcttgttttgaatccatagggatattttatctttcaataaagaatttctttgatttaaaatttatattcacgaaatcattctgtattgttttctagatttttaaaatttgccttagtgtaagttcataaaagtagcttaagaaatggaacaaaaaatcaaattatctttaatgtaggaaatactagatttgcatataatctagtctttcctatattcttccatccatatgatataattataaatctatgctaaacctgaccatggtgttaataaatttaactaccaaattgttggttcagaagtagggcacatgttttactttttcttcaacaataacagcaaaaacagggatgattaaaagtcacaaggaaaactataaaatatttaaaacaataataattatacttttactatattaaaatttggggaatgaagttaaaacagtacttttatgggaaaatttatagtgttaaatgctcatataagcaaagaagaattatctaaaagcaatgtcctatatggtactaccttaagaattttgaaaaaagatacaatggacagcatggtgattgcagttaataatactgtatgatataattaaaatttgctaagggggtagatcttaacatattctcaccacacacacacgcacacacacatacaagtaaaaaggtaataatgaggtaatggatatattagttttcgcaatgtatatgtgtatcaaaacatcacattatatagtatatcctaaatatttaaaatttttatttgtcaattatgcctcataaaagctggaaaaaaataacagaactgcacgtcaaaaattttttaaggaatttagaaaaagatcacagaaaagtcaaagaaaggaaataatcaatatgattgcagaaatcaatgaagtagaaaagaaacaacaacaaaacaaaataaaacaatagagaaagcgattcttggaaaacagcaacaaaattgactaactcttccctagaccgatcaaaataaagagaatacaaatcaccaattttaagaatgaaaggattatcattacagattctgcagaaaaaaaagagaaactattacaaacaaacatttgccaacacattcaacaacttaaagtagacaaatttctttaaaattgacacaagataaaacagaaattttgaactgttctatgtctcttaatgaaattggattcattgcattgaatgctaaaaattaaataaaaatttaattatcaaatttaaaggaatagtctcctttttttaaccttcacattgtgtttttttccctgtgattatatcataggctaactctaatgttaagagttgtcttcagaagcatggatccagtatgaaggcaaattaattacatggtcttaatggccctagaaattttgttttgagatcctgatgcaccaatctctactacagttatatcttttccaaataagatagttaggtaacatttcctcatgggaaatcctcaaatcacagaggttccccttttctaaacttggcagctcactctcctttttacacatttttttcagccatgctgatgttattgattaatcactcacattccatccaattttataaatctctggctttgttcttcctacttctcatctaagagatataatgtcttaaagtgacctctaaagatgtacagttctgttataattataaataaataattaaacaaaaacaatcacttcctttgttgatgattctcaatcattctctgctaccatctaactgtatgtaatttgataaatcacatgacgttagtaggcatcagtgttcttaagggttatctcttcaggtcagggacaatatttcatctctaaatcaccacaagggtcaacattctacctcaagcacagtagatgcttttaatatttattagctgattgatatgtaatgtccttttcaaaattcctattcttcaaatcactttatgtgttcttgtcaggtgtctaattataagactcttactctatagtacaaatatattttaagtcaactcagcataacaataataattgagtatatcacaaaaatttattgtatcatcctctaaattgattcttaatatatgttaggcaatactgtaatacatctatttcacatgtatccataagattgaaattatggctgactatacttttataaattttcttctgctattgtatctcatagttgatttgtccacaacaggttctgttgtaataaagcattttgggaacaattcatttattcattaaataaatacacatgggtggaaaataagtttttctttcatacctccattccttatgacaggtaacttccaaggccaaaataataaaaaatggccttttaaaatgtaattaacatttttttggagtaataaggtacaggagttatactagtaggatgtataccttcaaagaggcccattattacttatttatttatttttacatattccacccagaagccagtctgtcataaaggctggtcacccaagccatttctgcctcaaggatccaaagttccccattccactattcagtcatgacactggatgaaaaagaatatgacaaactacctaggtagaaggcaggcacttgagagggagagaaggagacagagggagaaaagggtttgaatcgtgcagggttggagcccgagagggcacaatctctgctgaaagtgtgtgatgcagagcccttgcacaccctggagagtttagcccaggaccggtccatgaggaaactcaggaataagatgacagagaatgaaaattcacaaatctttatgacccattggcattttgtatgaatttaattacaaaccctagattgtggtaaggaattggataaacatttatttggattccttgtgcatgcagtaagattttgttactatggctcctctctctagttgccatattgttattattaagcactgtgttaaaactagagatcaaatgccaggcttctcaactatgtgttagttatttgcttgtttaaacttagccaattaccttcctgattgcaaaggaactagtgcagtgccaattacacgcattatttttattcctattttctcccatttttatgttttaaacctctgtgtatgaataccttgctgtgaaaggaccacatggattttgatttctcatatctggttggagatttacccctatgaccttcagaaagttaataattagtatcttcttatttaaataaagagtttcatcaaatattagttattataaaatattctcatcattctttcctttctacactccccaaaaatgaaaaatatactcattttgattcaagataagaataaagaatatttaaattacttctttggttcagatcttcttgacaaaacatacaacgaacaagatatcttttctccagaatatactctttacaattttttctaccctaggaaaaataccgtacaaaaaaaatctgtaataaataacaaattagttatatttcaaggctatgtagtcttgtgacagatatactttttctagcccaatgtttctcagaagtcagagctgaggtttctttgttagaaatatgagaatgatgattgggatgtgactgccccaaactctttatagagatgaagctatatacaagtagctttagccactgaggggaaaaatgatttgtatatcagatatattattgtggataagtagaaaattttccttttataaagaaagttaaaacagacccgaaaaaccccacaaattaaataatcccaccaaacaattagtcatctctgataatacaagcctatttcagcaagaatttttaccttagagttttgacaataaggattctgtacaaatgaaatgccctacatgagctgaaaagtaggttcttttatctttaatgttattggaataaaccagtctaacactcacaatgaaattgtgagaagcagctaatgcatagatgtaataattcagagtctcttaaaatgtacatttcaaaaaggtagattgttgtgtttagatgcaagctgaagtgctgtagataagacagaactcataaaaagtgagaggctaatgttggagggagtggatgactgacacagtaagctctctgagaggctaaggaagaacagggtccacagccttcttaaataagatgggattggataggttgaaagacttcatctcccttgaagcaggaaggagggcagagagtgtaagcacaggtggaggtgggtgggagattgaaggcactctatctgctgggaggtgtgaggcaagcacggttatcaacaggaagtcaagtatgacggtgagtattgggggctaagatgaggggcaggaaagttgggtcaaatgtttgtggactgagaagatggtataaaacagtcattgtgaaagaggtgcaaactcagtctttctgttactttagtgcttatacaatgtgagggaaccattccataaaagtaggtacaaagatatcaattcaaaatttggagtgggaatgaattatttaaaatgagaaaaaaatcacaacacaattatgttttaaaaacctcgtaagtaccacaaacatgataaaatctagggaaaggtaatacatatactacccagcttacctctgtatcatccttcctatattttattgtaactgttgtattgcttcttcatataacaacaatgttgtaatattttttatagagaagacagaaagataatttagtattttctatagcttggatgattgacgtttgttttccataatttcattggtagtttagaagaatttgtttcagcttcgcaactcattattggtatgtgcaaatgtttataatttttttttaaatttattataatactttaagttttagggtacatgtgcacaatgtgcaggttacatatgtatacatgtgccatgctggtgcgctgcacccactaactcgtcatctagcattaggtatatctcccaatgctatccctcccccctccccccaccccacaacagtccccagagtgcgatgttcctcttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcacattttatggctccatagtattccatggtgtatacgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtgccaccaacagtgtaaaagtgttcctatttctcgacatcctctccagcacctgttgtttcctgactttttaatgattgccattctaactggtgtgagatggtatctcattgtggttttgatttgcatttctctaatggccagtgatggtgagcattttttcatgtgttttttggctgcataaatgtcttcttttgagaagtgtctgttcatgtcctttgcccactttttaatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtccattttgccttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcgttatttctgagggctctgttctgttccattgatctatatctctgttttggtagcagtaccatgctgttttggttactgtagccttgtagtatagtttgaagtcaggtcgcgtgatgcctccagctttgttcttttggcttaggattgacttggtgatgcaggctcttttttggttccatatgaactttaaagtagttttttccaattctgtgaagaaagtcattggtagcttgatgaggatggcactgaatctgtaaattaccttgtgcagtatggccattttcacgatattgattcttcctacccatgagcatggaatgttcttccatttgtttgtatcctcttttatttcattgagcagtggtttgtagttctccttgaagaggtccttcacatccttgtaagttggattcctaggtattttattctctttgaagcaattgtgaatgggagttcactcatgatttgtttctctgtttgtctgttgttggtgtataagaatgcttgtgatttttgtacactgattttgtatcctgagactttgctgaatttgcttatcagcttaaggagattttgggctaagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccaatttttgcccattcagtatgatattggctgtgggtttttcatagatagctcttattattttgagatacgtcccatcaatacctaatttattgagagtttttagcatgaagtgttgttgaattttgtcaaaggccttttctgcatctattgagataatcatgtggtttttgtcttctgttctgtttatatgctggattacatttattgatttgcatatattgaaccagccttgcatcccagggatgaagtccacttgatcatgggggataagctgtttgatgtgctgctggattcgttttgccagtattttattgaggatttttgcatcaatgttcatcaaggatattggtctaaagttctctttttcagttgtgtctctgcccagctttggtatcaggatgatgctggcctcataaaatgagttagggaggattccctctttttctattgattggaatagtttcagatggaatggtaccagttcctccttgtacctctggtagaattcggctgtgaatccatctggtcctggactctttttggttggtaagctattgattattgccacaatttcagctcctgttattggtctattcagagattcaacttcttcctggtatagtcttgggagagtgtatgtgtcgaggaatttatccatttcttctgtattttctagtttatttgcatagagttgtttgtagtattctctgatggtagtttgtatttctgtgggatcggtggtgatatcccctttatcattttttattgcttctatttgattcttctctctttttttctttattagtcttgctagcggtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgagtcccagagattctggtatgttgtgtctttgttctcgttggtttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaacaggtgtggtgtggtgctgaaaaaattgtatattctggtgatttggggtggagagttctgtagatgtctactaggtctgcttggtgcagagctgagttcaattcctgggtatccttgttgactttctgtctcgttgatctgtctaatgttgacagtggggtgttaaagtctcccattattaatgtgtgggagtctaagtctctgtgtaggtcactcaggacttgctttatgaatctgggtgctcctgtattgggtgcatatatatttaggatagttagctcttcttgttgaattgatccgtttaccattatgtaatggccttcttcgtctcttttgatctttgttggtttaaagtctgttttatcagagactaggactgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggttattttgctcgttagttcatgcagtttcttcctagtctcgatggtctttacaatttggcatgattttgcagaggctggtaccagttgtgcctttccatgtttggtgcttccttcaggagctcttttagggcaggcctggtggtaacaaaatctctcagcatttgcttgtctgtaaagtattttatttctccttcactgatgaagcttagtttggctggatatgaaattctgggttgaaaattcttttctttaagaatgttgaatattggcccccactctcttctggcttgtagagtttctgccgagagatctgctggtagtctgatgggcttccctttgtgggtaaccagacctttctctctggctgcccttaacattttttccttcatttcaactttggtgaatctgacaattatgtgtcttggagtttctcttctcgaggagtatctttgtggcattctctgtagttcctgaatctgaatgttggcctgccttgctagattggggaagttctcctggataatatcctgcagagtgttttccaacttggttccattctccccgtcattttcaggtacaccaatcagacgtagatttggtcttttcacatagtcccatatttcttggaggctttgctcgtttctttttattcttttttctctaaacttcccttctcacttcatttcattcacttcatcttccatcactgataccctgtcttccagttgatcgcatcagctcctgagggttccgcattcttcacgtagttctcgagccttggttttcagctccatcagctcctttaagcacttctctgtattggttattctagttatacattcttctaaacttttttcaaagttttcaacttctttgcctttggtttgaatttcctcccgtagcttggagtaatttgatcgtctgaagccttcttctctcagctcgtcaaagtcattctccgtccagctttgttccattgctggtgaggaactgcgttcctttggaggaggagaggcgctctgctttttagagtttccagtttctgtgctctgttttttccccatcttggtggttttatctacttttggtctttgatgatggtgatgtacagatgagtttttggtgtggatgtcctttctgtttgttagttttccttctaacagacaggaccctcagctgcaggtctgttggggtacccgcccgtgtgaggtgtcagtctgctcctgctggggggtgcctcccaggtaggctgctcgggggtcaggggtcagggacccacttgaggaggtagtctgcccgttctcagatctccagctgcatgctgggagaaccactgctctcttcaaagctgtcagacagggacattttcatgtttagaatttttgtcaaatgtgggaagtctcttagaaaggttttctcatgtatgagctgtaatacttgaataaatgttcacagagtagcttttattggactgttaccccaatcctacatctcttatacctttcactttctcctcatgttttagattatgttcataacacagtgtgacctagggtctggcttctgtgtgttgcaacaccgggtaagtcgacatagatgtctagtaataattttatatagaagtgattaggaaccatacaaatcacaccctactaagcccaaatcaaatgcatgtccaactcagtttccccttagctagatttcaaaaatgctgtagctagtccactgtcactcaaccccacaccacttatgatgaaggaatatttagagtggaaagagagaattatcctaattctggttaaaatatcttaattttgaaaattttacaaaagcacagatctatgcaaacacatagctgagatttgttttggagccttgcaaggggcgcatgtaagtgaagagcctgaaacctaatctttatcatcttcacagaaaatttagtctgcccgtgttgtggagaatgtatgagtacatgctttggctatacccagtaagatggaatggacaaacagaatggctgagtttattcaaggttgggttcatgcctggctatgccaaggacaaagagtcataggtattaaagttatatacaaagaactgatgataagaaagcatagctcatttcagctgcataagaagggaaatgaagggaaggcactcatgcatattagaaaaatgcacatggcaatgagtttaatgccacaaggaaggggctcttgaacaatttgagttggaaagacctgaattattccttgaaagtatggtacttaagttcatgattttgaagttcagtgatcatgacaatttcaatgttatcactgtgtcagtgagtagtaaggtactgtgggggaaaaagcatacctgatagaaatactaacagcaatggctaacatttactgaagaccttctctgtgtctggcattcttctagagaggacttgaagatgatatgaacaatgagagataatatataaactgacaatatctaggccagataccaaaatagaactctgaccaacaaacagcagtaaccagtcctagaagaccaaataataacccgtgaaacaacaagcctcaaacagccagtacttgattaataactgtcagcttccgtgttttccctgataattccccaatttttgcctcagtttccaacttagaaccaattagagaaagcaaaatatgtatccataaccaaccacatgggatgccccacttctagtttgactgtgtccagcttccccatgccaacagcattaatcaaagcattaacctgaagctttcccttttttccactataaagctttcctacttttctgtgtgcctttgcatctctaccaaattgaagttatggtggccgactcacttgctatagcaagttcagataaatagcaattgccggttctttgcatagtctttgtttattttcttagcagtcaaggttttgaatgagttagccaccttaagaaaatcacgaaagagttaggatgaagaagagaacagtgatccagtttctttggccttcagggagtgaagagccacgctgattatgtcaataagactcatgaagcaggtagtcagccagatggtgtcagcctcggaggggcaggggttttattaagggatattatttaggacatgggagcagcatggaaacatgaaagacaccttaaggattgagtgtgtggcttaaagaggctttaaaaagagtggaatctttagaagatggctaggttccagttgaggtaaatgagtgaaaagaaggttctttgaatataaagaagagtttgctgatcccaagtacaaactttctcacagcaccaggaacaacttttggaggaacggagtaaaaggttgggtgagctcatgaatggattgggaaggagatgtgtattctagagatggtagatagagagtggtagacatgtaggtagtgactgaggaaagctgggatattaagaaaaacatattgcatccttatactaacagtggtgtaaaaattagggactatcagaggagcctgaagggtttcccacagtttttgtcaatgggatgctctggtatactgcttaaggagatcttatgtggcaggatggtggtcacaccattgtcatttcagctatcacataatggttgcttaggagagctgtaggtacagatatatctgttaagaaacccacagactaacgagtgtggtgcttggaagtgggacaggccaggatagagattagaatggcaaagaagaagctttgacttcactacaaagatgccctcaagacataaggttggtggtccttccttcctcctttccttccttcttccttcttcaattcttcttttcttccttctctacttcccttccctaaaactttctaatagcaagtttaattatccatagttcatagagaaaaaacttgagccacagcaattttaactcagtataattacttagtagtaatgatgaagatgaggaagaagaaaaaaagcatatttctaaacttctacctgtccctttggcaaagttaaatgtagtctaaataactccccttttggcctgtgtttagacttaaggttcagggtgatgatttatcctgtgagaaaggggctgtaataactagaagttctctctgcacaatttattgacaggcacacatggaaaagtgtttgacgatttgtcaaatcacatatttgcaagagtccatttgctgtgttatgtcttcatttggcccttttaatattttatcatactatcccaggagtataaagatatagccacatatttagcaaagacaatagcctagggattatcaacaagtaatattaattatccacttttgtagccagacttgaaatcctggtcttcataaattaaaaaatatatgtattttttattttttcagagtttaccaatgactaagagatggggtagtttgtcagtatcttattcattttcctaggtcacctttaatcaatcctcctattttaattttggcgtgaggcaaaaataaagcacacgtaagcagggttccagagccaccaaatgggtgtagttcttaattatggcagagaatacacattaactacttaagagggtgacagacttcagagctcaatcctcagccactactggcaggagcctgcagtgacagttcagcatcacttctatagagcgttccatttttccttcctctggatttgttttcttcctgcttctgtcactcggggaaggtttagttttgagtaatgattatctttctcccttgtttttgtcttttcttttctcccacttctccaaatggcctatctgccagtcacaatttttgtggtctgcaattctgatcatttttaaatgaaacccatgctggctttggtaatcataatgtcatttacaatttaccactaaacacgtttattcagttagtagcacactggagaaagagaactccatatgaactcaccgtgaaaggcctaatctgattatttcctcatgaaaatccaggcaggggtgcttgtaagaggggctgagagaagaaggaaaaaagcgagatctggccacagctgactttcataatcaatgtgaatagataagtgacacagcctgtcaggggcagccgcccagccaccccagggcattcctttccaaaaggctagggtggacagggcttaataaatgctgagtgaccagtgagtattggcttggcatatgctattgcatacacgatggacaagaacatgataaagtccagaagctcttctctaagtggggaaaattagattaagcaggttgtatttgtgtgtgcatgtgtgcctatgagcacttgctttgtgtatactttaacttcctaaaataccctggtcattcagtatgctctgtccacctttccctagacaggaagctacagacgtagaaaccaaggcagtgagtgaagtctgtctggtggcagaggaggaggaaggaggcaggtgtgtatgtgtgtgagtgcatgtgtagattcaggttgcttccagggttctaacatatattaactttgtgtcaatatttgtccttcctgtcgtgaaatgaggattttccacctcatttcacgtttgaaaagaaaatatgccaaaggggtcgtctttgctagaaaaaaaaaaaaattaaaagaaaagaaaaaaaaaaacttctattctttatttagaaaaatggatctgaaggaaagaaaaaaatttaaataaatgttctgactcaaatgcacatagaatccttccatatttctgttttcaacaaaaaagaaaaatttatatgtttaaaattgaatgaaatacatcaacattaatgattttttccttgaggttaacaccaccatttccctcaataatttttttagccattttgtaatatatttcacaattcatggtaaagtgtaggagatttgacaaaaacaaaatatatactcattctcttattttcaagaaatgaaatcatttacaattcttttgtggcaaacaacatttatacctcatttgatttctaatttaacaaatataaatggtcccagatcaaataaagtgaagacaggttgaatttatccccatttatatatgttgtcacaggccctcaggctatgaggagtgaaactccaaaatctcaaagctgtgctcctcaatacacaaaagaagtaactgtgatcttccaaagaattattaaagaaaatatgttttggtcataatagaaataatagagaaaaactgtctgcttttctagaatgggcaattctaagcaaaaaatcatttgtttaaacttcaaaaaaatgggtgtatgttacacttataaggtgaaggcatattgagagtgatgttcttaagcagaatagattcaatataggtgataggaaacacacccttgctaatctggagtctagaattagagctacttaaagtctattgagggaccataatatggtagttctaattattatgaaaaagatatatatgcttgcacatatacacactgataggaattattataaccaaactaagtacaattataatagttattattacaagtaatatgagaaacttaaagttcattagattgaagaagtacaacatgtattcactcactgcttaggtcctagagcttcaaaattaattcattttcagattgcctttcacagtttgttagacagtggcccttcagagtatagtcacctctggcaccattttcaatgaggaggatgcactctaatagctagttactggtgtagtgaagtggctttcaatgctcgggagccacaaaacgcccaagagtgaagacagttcgaaaggactgaagatactgcctaagaacaggaagctgctgtatgaggaatatatgcatctgcaggtgtaaaatgggctggtagacttcaggaactacagatcataggatctgtcacaattttatgagcaatctcgccaaagttttgtagttgggcctattttccatgaggacgcacttccaaattaatacaagaaaaacggaaaactacataaaaccagctattgcatgaagcaaaaaatgtctgtaagactttctgttaaaggcctttctgtctctacaatcagttctttcagggaatatctcaaaatatttgttctcttttaataaaagttgttgcattgataaaaaagatcaagagatgaaagttaagtgatggcatgacaatatgagagagaaggtcagatctatacccaatagacccttcttctgattcaaccatttttcctttttacttttttaaattcaaaaaaaaatccttacttttattagtagaaatctgttcaaacaaattcaatagactattttataattgttttactagggtaaaatgtcatcatctatacattgcttgaaaaagtggtttagaaagtgtttttgtattttcgttattttgttgtaatatgttttcacctgaaaacatcaaagaatatggtcccaattatgattttattatttgaatattacattgaaaacagcccaggcaaattcaaactcaggaagtacagcttagcgagtgggagatcagattttaaagtcagagagacttgcattgcaagctggctctgccactttctagctgcaaaacacagacaagttacttatcctccctctgaatcatttttttcattgtcaaagggattggaaatggtacttaattcataagctgatggagagggctaagttagatgacgtatgcacagagtgagagaaaaacacatgttaataaatacaagctgttacattcctataattttaaaaagagaatttttaaagctaccttccagtctccttttgccttttatggctctatccttatctcaaaccagtgtttgtctagtattctggaacagcacctgaagtgttgcaaacattcataataaacactgttgaaagagacaagttacaggtgaagaaaatgctggaaggtagaaatgacaacctatgttttcaagaaaatatcagcaagaaagaaatgcacatacataagtacatatacatctgtgtgtgcctgtgcacatgtgtctatgaatagagcacctatattttccaccaatcaagaaaaaaacccaacctgaaaatctaagattattttcctgttcatctattcttaactttctcttcatttcttttataatataatattcgccatcatcaccctacaccttctctctaccttcttactttttaatgttaattttatttatttatttatttagctagctagcaaatcttgcctgccagctttaaacaaactgatgttcatgggttaaacacaggagcagccaacagcattctttgcagatgcaattcctggcacactctttacccagaatgataaacttatcacctctccagccctcagtttgaagctgcagcagtaatttctgctgggtgccaaaactaaaatgaatgtgactgtgccatgccctgctctgagctgtggctataatgagatttgaatgggaagccccggacacaataaatctgcgccatatgtgaccatttcctgtgtcagttcctttctcataaccagtggagaatttttttccctctcatgaccccacaccatgactctgaaatctttcatggctgcttatgggcctcaggctttttgcagcagttgtataaataaatgaatttgacagcaaacatcataacagttagcagtaatgtgtgttcgccacaagtgcctatactactcactggagaaatggcacaggaaacagcttgttttgttacctaaacaaaagtagtttcgtttgacaagtggtgaaagaattagtcaaataaacttgaaatccactaggactttttttttttttgccaactctccctgccaggggaatgttcccagctcctgagtgcccatgactcacagaaggtaaatttctccctttttattctgagataaagatctgcactgggaatacaaaaccttcgactgatattttatattaatcttttcaaggcaagagtgtcatgcatgggaactcaggtagtcaagaatttccaaggaagcctgtggtagaaatgccaagcaggatgtttcgggaggaaaggaaaggtggtaataatgacccaactcggtgattcccattgaaagcaaattgaagcttacaagtgcttcttttcctttcacactgcctttattcaggaacaaaaaatctctacacaagttgctgaaggaaaggaaattagcattttctctgcatctcatttctccacccttcctctggcatcttaatgccaatcctgttgtctctgctgtgaaagatgttataccacagtgattattctcaggactctggagcaaactgcctaggttcaaatcctggctctgcttcttaccctctgtgtaactctaggcaaataacttggcctcattgcatctcagttttctcctttgcaaagtaggaataataatgctacggtatcaagctcctaaggtgtctgtgccaattaaatgtattttaaaaggctcagaacagtatctaaagcataatatatattattattattattatgccaaacagagagatttggaaaatagtctctctagcagtactagaaattttttccacgatggcttgatattggcagctaatctcagaaatgaaatttaaaactttttggggaaaatcataataggagcttcatgtaaaccattacgattaatttcaaggtacagtacaacactacttgaaataaaaatatcacctggaccttgaaattttttcttatatgaaggttattttcacacttttaaaggtgtttacactttatcataagtggccaagtaactattgcccctagaatcttctcatattgcacagaagtatcactgattaggagagcaaaactcaagagttatcacaaactaataaatcttagtccaggtatatgttctattttggttttggttttgtttttaatttaattattaaaatgcattcactgaagtattttgcttgtgtgacaattacaagaaagtgccataaaattttagaaggtatggacagtaatcaacatgaacaataatttcctattacagacagcctgctacctacactatagattcccagtgtctttattttaattaaataaaaaatccacttgaatatacatttctccatatttaaacttccagactatagtgaaaagtcacaaatataaacaaattaaactattgtaaagataaatgaacggttaacgttttgctctgagagcaatgccaataaaacttgaaagggtgttaactgagggtaaaaaaaaacatatgcctttataagacaatgaagaaccagtagggggacagaataaatatacagttaaaaatcggttggttgtgaattggggttaaggattgacagaaaaccaaatacataagtggcatccctctattgtaaagcaagtttaagtacaactccatttctagtaaaatcaatggaaaaccccattttgtcactgctgcccatgtatagactgcattgctacatctaggaaacctctcagaaattgatctatgagaaatgactttttccccaaggcaatttcactgctgtggaatgtcatctgataaaatggctcccttgctacttccaaatcctttcccaagatcagcttctaggatgtatttcctaactcaccttaggatttccaaaggtgaagatttaatgctgtgaataactccagctcttcagaccagacattgccaccaaccctgaataaacacaggccttagcaatgtcatgtttggttgaccaaccactgctattgccccttaactagcaaataaatactgccaccttgtaaagtctgtttttctgagttaaagagaacactgaagggaatagatgaactttaaaagaccagtagccttaatcaagcatgtagatctgtgaaaataactgctcagctatttcttcattgttttccttgtatgtgtgtgaatacatataagcctagccttgcacttccccattatcttattggtatcttaatgactagttaataggatcattaactagtcattaaccattgagcagaggtaactagtgtcccttttgggccatactatttaattgaaagaggtggtgaactacaagccacaggccaaatcaggcccactggctattgttataaacaaaattttattggaacacagctatacgcatttgtttatgtattgcctatggctactttgcactacaacagcagagttgagaaattgtgacagaaactgtatggcctacaaagttaaaaatatttgccacctggcccttaacagaacatgtttgccagtctctgttctaagagttctgagtttgtctcttgagacagtgaccagaaaagtatgagatggaagctgatctttcagcttgagttcctgccaaccaaagatggacaagaagtacaaacgagaaataagcctttgttgttttaagctgttgagatatatacagcatcagggtagactaggttaggatgtcagtactctgatggatgcagcatctataatattcttagatgcatcttttcctccgaacatatatactatctcctgcttcagggaagaggataaagaacataagggaactcttcttttgtccccaggagacctaggatgaaaacagaaacataacacaattttctctctaaacacaagttttctttacataatttatcataatattcactttttctaatacctgagcatcagtattctctgttaaagctctttgtaaaactagttctatgaatctcttcaaatttgccttcttttccagtgtgatataaagatgaaatttacttgacatactgcgcacagattactgaagtaattaggtaaaaatattttcataagcccagaattgggatgctctagtctctgagaatgagttattatatttgggctttgctttaatatgggtgaaaaatgcacacagctggctctgcttgctcattttgctatgtccaggtcttctcctttggaggaaaaagaaacagggcaagttgagtgaacagcttgcctctgcttctgctttttggaggcagaaagtgatggagaccaaaatgagagtataatgttccttgtgtcagctatagaagggaaagcctaggggagtcttaccaatagaagctctgtgacctgaggaatagaaacagtagattgaagtgtcaatttcagttgattttcttcctaatcctgctgactttgaaaacagacaggctaccatgcacctcagtttccttattatgcatacaaagcaatatacctggatacttacctaatacagggagaatacataaaagttatttgtactaatgtctgggagacatggcaggggaaaatatattgaaaaaggaggcttttacccaaacaatcagctaactagcagtaataaataggatccagaagaaagagtgaataagaaacatggtgagatcaaccagataccatttagtcagttgaacaaatcaactatgaagatttttttacaaacaaatttgctagagttcttacaaataagattctggctcagaggatttcaggtaaattacttctaagttatcctttaagttcaatgactcctcctgaaaactgatgtatcataattcagcaaggtgagcaaattttaaggacaattcgggatccaattttgagtcagaaaacataactagattacagagatacacaattgacactaaacactgggagacagaatggcttacttataccaaaggctttattcaaactttgaggcaaagtagtggctggaactataagaacaaataccaaaaaatatatttacagatgccaatcagacaacaaacacaatatataggctcaggatgggaaagtatacctgattaagcaaaattgtaccttattttcaaccatatataaggttaaagaactataagcagctgtgtactatggtctgcatatagaaatacttcaggaccatctcttcaatttggatgatgtatggcatagactcaggaaatcatagtaatcctaggttttattccatcacatcagattttggtaaattccgggggcagtgtgagtaatacagaggaaaaagaggaaagaatgtaattttctagctcttccattgtatagttgtgatattgtaatcattgattttatactatttattgaccatttgccattatcctgataatgaattcaactttgagattataatggttaaaaattaaacgagagacacagtgtttgccttcatggagcttactcagtcatgtttttagaaacaaattctccttctcttttagagacaatgagctcatgagcaacttgagtacagatatcagccttattcacctttgcatatgtccttctgctcccatatactcaaccagtgcccgatatacaaaccaagagagaagaaacatcaacatttcctgagtatgtaccatgttccagctattctgaaagtctttcaaccaacagttcttattttatttaattatcatagcaaactgagcggtgtgtttttattgcttccattttccaaataagaaagttgaacttgtagctgtacttgaaggactgtgagataacagaactaaatgttagaagcagcctggttccctgagtcaccaccaggagggcagctaccaggagagtcacccaaccttcttcaggctgagatgtgagtaaaacaaagtttttctattcttaaacaactgagatttggagattatttgttaattggagtaactctgtctcatacaatatccatgttttatgtaaataaagaaaatttaaaaagtaagtacatacagagaggcaatgaacaaataatgctgaggtcccagttagtttagaagcaaaaggaagagaaaaatacaagcaatctgacattgtgacctacactacagctaccatttaaagaggctccaaggggatctataggacatcgttgtcttcattctgtgctcttggaagttcactaagaaatgactgtggataaggtttgccctgctagatattcccccacttgatggccagcttaaaactgatttagaagattttagagactgctagggattcacagctttactaaggtctgaaaagcaagcacttaagcagcatactgcatgccaagaaacaaaatcagaaggtacaagcagctggtttgacctttgagaaaagtttggcaaaagggcaagagcatatttataactcctatgggacagttcatgtgctttccattggacttgctctgtgtcaaaggccaatttccatccattatgattcactaagttagttttatgaatattatgtttagagaaaatcacacactgggtcaaaagcaaaattagagcatatccatcattgggaagtttatcatttcaccaactataaaattctttttgcttgaatttaaggctgattttccctgaaatacatgattttccagataaaactagccactgatctttcaagaatagttttctgggtcaatagaagccgccttctgggaaaatattacaccccattacacatctggccaattctttgaggccattcaaactgttaggagtaagagtgggagaattccttcctgtcctctgagacaatcattttataccccaaaacttcaacctcgttattcttatcttagggcataattacaatgttattattggtcataaaattaaccagattttcctctcttttcttttcctcttcagcatttgactccctgaccttcttcaacagaaaagtctatgggctgattatacgctaagaatagaagtatttcctcttacttgttttaaattttcccactgttaatttctttgagagcatacttgttctcatattacaaaacaatgttaaaaaaaatttttttaaagaatttttactacttctataaaatctgaaaatttttgctcttgtatcccagtgtttctgagattggtccctttcgttatctcaccatccagaggtcctagcctacatttacgttggcctatagttacatgattcaacttataacctaaggccccttgccagttgctccctgcacttcactttactatttcccgaagcaacttctttgttttagttgaggagggttgctaccttcctgtggcagtggttgccaaagtattgttttaagaatcattaccaggccatgtaaggacttggtagaaaaaatggttttataggttagcagtctgctggtgtgaggggtggaagatatggtggagccttggaaaactcactgtcaggaaaacacagctatacctcctatgcagacactttgctcaacagcacttaggcacaacttacctgctgtctaacccagaactccatccaaattccattccacttatccacgtctgacacttcttaagtttctataaagatttttctaacactctttctctgctgatcactggctgacaaaattcattctataattcactctgaaattgacagcattgtcctagatggatggcatgcttggatgacagcacctaaatcttacctagagattcaaggtgagaaggtttttgaacccttaactcatgttcaccttgtaaagaaggatgatcatccttctactgtttatattaaaatgattagacttggtaatctttaaaaccacaacaaaagctggacttctttccaaagaaccagaacgctttacctctgactttgtcttctgctaattcccttcctggtcattctgctcaagccactctgacttccttgctaatcctcacacactgcaggcactctccccacttggggactctgccaaggcagatctctctacttttctcccaggtgttcctgtggctcaatcccacaccctcttctctgtctccttctcagtgaggcctactttggtcagcctatgtacaagcattctttttgctttctatgatgctctacattttttcttttgtctatagcacttataactttataatctactagagaatttacttatttattatgtatattacttagtcactcctctaagtaagctaagaaagtaagccctatgagagcagggttatttgtctagttttgacactttacaactagccagaaaagcaccaggcacatagtagactcagtaatatgtgttaaattgaataaacttaatgcatccattcgttttcaatgattaactctagaattttcctgattcgctcagattgaaattgaacattcaagttgaaactatgatctactcacttgcatgtttgaaatctacaaggacaactttctaaaaatattttgcaaggactgtatatttcatatgtctttcagaggccagatatgaagttacattttctcaggtactccactttctcttggttttcagaaaagttgatgttcttgccctcctgaaatcatggcaccaaaaacggggatgtaagttctttcattgtcaagagtgaatgagaaggaaaggggaaaagaggagcagggaagaaatggataatactatttctagtacccttccttcacagagaggaatgaattaaacatgaggcaagaaggtcaccaagttagttaggcatatgaattaaatcagattgtctgaagaaagtactctatgaagatagggcacagagaaagaatacaacaaaaatcagatgataaaaaatgaaaaaaaaagttgcatttgtatggcacattttaatatgttaagtactaataataactcttgccattatgtgttaataatagatccttttctgtatcagctatattgtatgcattatatataaatgttgacaacatgaaagataattcctgtatttctattctacagataactaaacctaagctcatggtgttaaatatccatagacacccatctattcagtggccagcagggcctgaagccatatgatagccaccattgcacacattttgccaccatgtcacctgttatcatttgcccttcacaacaactttaaaaggcagaaataagaggtgggatttccatttgcctgatgaaaaaactgagtttcttaaaatttagtacttgcccaaagacaaagtgaattaattaaatactggtctcttgacatctgtgtctaatgttcttgtcataacatgatgttcttgtcataacatgatgctcttggtgttggtaataaaactaatgtttctcaaatagaggatgaatttgtgagttagtaaatcagttcagttttgacactgcaatctccaaagagatcctaaaattattttcatattttcaaacgatgtggattaatactcagtatcagattgcattctacaaatagtattgccttgagatccatccacttgaattaaccaaaaaatactactaattaactagacttgagaaagggctggtactaggcaatgtgacttttttatgtcatatgtcacctggattacattttcactctgatgtacatgtcattgacagcagtaggctgctagaatttgacaccatgaatttatctgatgaagtgcacagaaagagatctgtttattaattcgtaagcacaatctagagccattttataatacagtatttcccccttcacagaatgaatcagtacttgactgatttaagtataaaatgccttggtttgttaaacacaaccccatattggggagaattggacttgggttctactagcagttgtcccaaaatttgctattcttaaacaagttgtcttccctctcaggacttcaaagtcaccatcaaaaacttagaaacatctcaagttaacaacctaatatcacaactaaaacaactagagaaccaagagcaaacaaatctcaaagctagcagaaaacaagaaataaccaagatcagagctgaactgaaagagatagaaacacacacaaaaaaaaaaattcaaaaaatcaacacatccaggagctattctttttttaataaaaataaataatatagatcactagctaaactaataaggaagaaaagagagaagattcaaataaacacaatcagaaacaacaagggggatatcaccacggaccccacagatatacaaacaaccatcagagaatattataaacacctccagtgttttctattttatgcatacaaactagaaaatctagaagaaatggataaattcctggacacatacaccctcccaaggctaaaccaggaagaaattgaatccctgagcagaccaataactaccttgaaattgggtcagtaataaatagcctactaaccaaaaaaagcccaggaccagtcaaattcacagccgaattctaccagatgtacaaagaaaagctagcaacatttctactgaaacaattccaaaaaattgaggagggactccgcactaacacattctataaggccggcatcatcctgataccaaaacctggcagagatacaacaaaaaaaagaaaacttcaggccaatatccctgatgaacatcgatgcaaaaatcctcaataaaatactggcaaaccaaaaccagcagcacatcaaaagcttatccatcaagatcaagtagtcttcatcctcaggatgcaagattggttcaacatatgcagattaataaatttgattcatcacttaaacagaactgaagacaaaaaccacatgattatctcaatcaatgcagaaaaggccttcgataaaattcgacatcagttcatgttagaaactctcaataaactaattattgaaggaacatacctcaaaataatgagtcatatatgataaacccacagcaaacatcatactgaatgagcaaaagctggaagcattccccttgaaaactggcacaagacaaggatgtcctctctcaccactcctattcaaaatagtactggaagttctggccagggcaattaggcaagagaaagaaataaagagcatccaaataggaagagaagaaagcaaactatccttgtttgtagaggacatgatcctatgtcttgaaaaccccatagtctcagcccaaaagcttcttaagctgataaacaacttcagcaaagtcttgggatacaaaatcaatgtgcaaaaatcactagcattcctatacaccaacaacagagaagctgaaagccaaatcacaaatgaactcccatccataattgccacaaaaataataaaatacctaggaatacagctaattatgggggtgaaagatttttttatccaaaactaaaacaactgctcaaagaaatcagagatgacacaaacaaatggaaaaacattccatgcttatggaagaaagaatcaatattgttaatatggccatactgcccagagcaatttatagattcaatgctattcctataaactaccattgaaattcttcacagaactagggaaaactaggccaggcgtggtggctcacgcctgtaatcccaacactttgggaggcagagatgggcggatcacagggtcatgagctcgagaccagcttggtcaatatgaagaaaccccgtctctactaaaaatacaaaaattagccaggcatggtggcatgcacctgtagacccagctactccggaggctgaggcagaagaatcgcttgaactcgggaggcggaggttgtagcgagccgagatcatgacactgccctccagcctgggtgacagagtgagactccatctcaaaaaaaaaaaaaaaaaaaaaaaaaaaagaactagggaaaattatttttaaatgtacatggaaccaaaaaagagatcgaatagccaagacaatcctaagcaaaaagaataaagctggaggtatcatgctatccaacttcaaactatactacaggcctatagtaatcaaaacagcatagtactggtacgagaacaagacacagaccaatgaaacagaagagagaacccagaaataagaccacacacctacaactatctgatatttgataaacctgacaaaaacaaacaatgcagaagggattccctattcaataaatggttctgggagaactggctagcaacaggcagaagattaaaactggaccccttccttcaccatatacgaaaattaactcaagatggactaaagacttaaatgtgaaacccacaactgtaaaaaccctggaagaaaacctaggcaataccattcaggacacaggcatgagcaaagatttcatgacaaagacaccaaaagcaattgcaacaaaagcaaaaattgacaaatggggtataattaaataaatagcttctgcacagaaacagaaaataccaacagagtaaacagtcaacctacagaatgggagaaagtttttgcaaactatacttctgacaaaggtctaatatccagcatctataagaaacttacatttacaagaaaaaaaatcccattaaaaaatggacaaaggacatgaacagacacttttcaaaagaagacatacatgcagccaacaaccatatgaaaaaaagatcaccatcactgatcattagagaaatgcaaatcaaaaccacaatgagataccatctaacaccagtcagaatggctattactaaaaagtcaaaaaataacagaagctggcaaagttgtggagaaaaaaggaatgcttatatattgttggtgggagtgtaaatcagtccagccattgtggaagacagtgtggtattcctcaaagacctaaagacagaaataccatttgacccagcaatctcattactgggtatatacccaaaggaatataaatcattctattataaagacacatgcatgaatatatttgttgcagcactattcacagtagcaaagacatagaatcaacctaaatgcccattaattatagcttggttaaagaaaatgtggtacatatataccatggaatactatgtagccacaaaaaagaatgagatcatgtgctttgcaaggacattgatgaagctgaaggccattatccttagcaaactaacatgagaaaagaaaaccaaatactgcatgttctcacttataagtggaagctaaatgaggggaacacacagacacgtagacaggaacaacagacattggggccttttgatgggtagagggtagaagaattaagaggatcaggaaaaataaccaatgagtactaggcttaatacctgggtgacaaaataatctgtacaacaaacccccatgacataagtttacctatgtaaaaaacctgcacttgtacccctgagcttaaaagttttaaaaaagtgggattcgattaagtaaattatcattgatgtgcctttcagcattcaccaccaaaagtattttatcacctagagatcaccaagctactacccaatctaatggcaaacgctggctcttttcatttcttacgaaccctccatctccaacatactaaacaaggaaacttgtctctccagtcaaacctccttcttttccacattcactctagtcttcagttgttcagccctttctgggcttcctcccatttcatacctaacagcaactcctttcttcatcattcacttaatgctcaaataagtattctcactcctcccaatctctcaaccttcattcttctcccatgttcacattgaaaatccccagttcttggcaaagctatgtatccactgccatcacttttgcttctggaaagtttaagaattctgtagaaaatcacataattcacacacacacacacacacacacacacaccactgagttctgtgtcatttggtgctatcacaaatgctttatttccaaccttaattgagccttcagtactaatcaactcatcttccattcatctctagttaaaattcttttctgttcaaagtttgacctcttgctattcttctacctccatgacttagtcactgatttctcaaacaaatctgaggacacttttaccaaaaccttttaaaaatattcactcttccttacctccctccgacatggttattcttccttttccctaggtatagtttctacacaagtgaccttgtcccagtctactcctccttgaacatcacaagttagtctcgtccatttttttcccatttcttagatgttcaaaattcttcccatcaactgacagatgcataagttttctatataataaacatcacctatcttttttttccacttactgtcaaactctttgaaaagctaagttttcttatggttttgttttatattagtatttattgtttaatttttctcatgtttttgataaatctcaatccactgacatctagattttgccccaatcactctgtcaacactattctcagtaatgttattagaggcctttattttctgatttaatcattttgacttaattataacattttttgctgttcttgaaatgttctttggatttaactcttagggcatcactatctccttatttctctcttatctttgtttctcctcaactgtggtatgtattgttgttttttgctgttttggtggctttccttgacctgatcatttatgaagtggtattcttcagggttcagttatttgtcaacacatatgtcccctgcacaagtgcacattcatacacacacatagaaagggagagagagattcatgtactaataggccccaaaatcatcatctgtcctgaataacagaactgtattctcagccacttttctctatgaaggcatttcacacatggctcaaacataacactttcccattggccctccatgcctccatgtgaaccatatacttactatctactacttaacaattatttgacttaagagacccagaaaacaaatggcttatgtatgccttattatacaggcacgtttatacaaaaagatttctttagaacaacttctaacatttacctagaactgaccatgtgcctgggaccttgtgaagtggtttacaaagattgtagcaaatctaatcattacaataaacctaaatagtccatgttatttttatctctatcaagatgtagagatagactaaagagaagttcagaaatttgctgaacaaataagtgatggagacagaaaacccatccagcccagctggttcagcggatgagattgcctccagaagacaatatgggcagcttcattaaaaacatgggatggcagtggtatagccattacctcctttgctcattgaaaacaataacaacaataataataccagatgacatgtactgagtgactgagtgcttacaatgagacaactgctgttttaagtgctttataagcattaattcatttaatctccacaataaaaaggtattactattactcccattttacagatgagggaaatgaggcatatagggcttaagcatctttttcacttttaagtagcttgcagaaagtgaacccaggcaatctgattcaaaccccctgtccttgacctctacattatattattttactatataaacaattagttaagtttcttaaagtagcattgagtgctgagtcctaggtaccccattcccgcctctcttaccacctcaccaccaccaccatgccacctggcttcatcttaataattaatattcttgctgttatgatgcttttttttaaattttctccctcctacctgctttcagcttgttagtttttaacaatgcctgcaaatgttttctttctcagttccaaaaaaattctactacattctggtctcatcctggataatctaattttactgatctttttcacaagccacacctccaccacaccagcaaaaaaatgaaccacttaaaaccactaccactcttccatatggatttctttttttaattaattcattaaatttatttatttacttattttgagatagagtctttctctgttgcctaggctggaatgcagtggcgtgatctcggctcactgcaacctctccctccctggttcaagcaattctcctgcctcagcctcccaagtagctcagattacaggtgcccgccaccacaaccagccttttttttttttttttttttttttttggttgagaccaggtttcaccatgtcggccaggctggttttgaactcctgacctcaagtgatccacctgcctcagcctcccaaagtgctagaattacaggcatgagccactgcacccaaccttccatatagatttgtaagtcgtgagtaaccacaaaattttactgttcaaatcaagagttggtgctattacaattatgttgggactgtgtgtataaacagactgtgctgagtaaactgagtggtacagtcacatcacttctgacccacagaagacaacacagctgtactgccacattgtcactgcagagatttccttgctaacagatttcccactgacaatgatattatggtttcttccaatggcactgactataaaaaaaattggaaattctgctgggatctatgaataacaacaagcacaaagaaaacaatgttgccaaaattttaaaacaaaaattgaagaataaaggaataagatttaaggttttaagtctattataaccaatggcaagtagacaaagctgaataaaaatggacttaaaagtatttaataatatttctttaaatcagcaggatttaaagaacagagaccttacttcttaaagtcttttcaataaaatccacagtataatctcattgaaaacactcatcttgttaaataaacattatctaatgaacaaaggattttctcaaaatcctttcatatcttgttattctcaagtataaattgaagctttcaacttgtctttataatgtaacctcaatctcaaccctctaacccttctccatagcacttaatactgttattcctgaaacataaatattgctttgccagagaagaagaagaaaaatgaagaggagtaggaggagaagaggaagaagaggaggaagaagaagaggaaggagaggaggaagaagaagaaatctttaagtccatagtttattaaattggtaggaatcaggacataatttgtatctatgtaacatattcctaggattcatttctatagttattcagcttgaagcagtgttgtgtttacctgacactcaaaaactgatactcttgacactcagagaaagttattttataggttatgaaaatgatgactgatggctgccttatatccttggtttaaaataataacaacatggatatatgtgaatatctctgaaaaatatattaacaataaatttctacgttttgtagaggctaaaaggtagaaaaaattctttatgtaacagggattctaaatgaaatttttaattccctctcttcccccctttactatcttgtgtctgttgtacatttgaatacgaagagcagaagaaaaatggcacaagcccaaagtgaaattttgaggtaagaaaagtttgcgttgatggtccttttgcttcttgaaaaataacctgttccacactggggctcccaaaactacatctatttcttcagaagaaagaatctgtcatctttatttgaattgtaataaaaacttcttctaagaagctagcactcagtttgcatttacaaatatgaacatttaaaaaatctctagttgtggactgaaaggaattaaagcaccaagtttcaagcagtgctgtggtttttagaaaagtctcttctcattgtttgcaaacctgtagcacttggaaggctactctgcagccagttctgctttaaagatttggaagtgatgggcagacacaaagtcagcagagaatggtagctgatctttaatcatagatacatcagtgatccctggaaagaagaaaatggggctgaagcttccagaaggttagttctcagaagcagtagagcaaggttcacgagagccatcatgaatatcacccaactaagcaaaaatctgtccaaatgtctagaaagtggctatcttaagtctcaaaccaaggactgagaaactcaaccccttctgtgcaacctcccctgatccattatgtaatcatctcctgctccagaactcttaccctactgttttctatctcattataaagagtttattttcagaacagaaagagacaaagcaaatggatatcctgctctaaaatccatgaagtttaataggatcaacagctaaggatgggatgagcaagccaggttagaggtggaacacaggggaatgtggccctagagaactgtgcgtgggatagagccccagctgatgggatatgaggtccagaaactacgtgtgtcattgatagtgggagatggaaaaaataaaccaaactgacgaccaatccttgaaaattaactgtaaaagagaagagaggaaaacagtatttagtctcacaggtttaaaaggatactcataattgggcctggtgtggtggctcatgcctggaatcccagcactttgggaggttgaggtgagcagatcacttgagggcaagagtttgaaaccagcctggccaacatggtgaaaccccatctctactaaaaatagaaaaattacccaggcatggtgacacgcacctgatgtcccagctactcaggaggctgaggcaggagagtcgctgaggcagaggttgcagtgacgtgagatcgtaccactgcactccagcctgggcaacagagtgagactccgtctcaaataaataaataaataaataaataaatataaaggatactagtaattgtcctcttaatgagtgctttggatgtgtgcctaaccaaacacgctgtgaggtaattgtagtgcatgtcatgaaatttgtgttagattagcatttatttgcaattactttgattacaataattgcaatcaaatctgattggagaggtctcttgtgaaaatcccatcaacacatattctgcacctaccatgttcaaagtattatgctcaatgctgaaaacacattctcctcacttcagaatgggggctgtcaaccttggcacttttgagatattgaagtggaaaattgtatgaggctgttctgtacatcataggatatttagcagcctccctggcctccatccactaaacgcccataagtacacccccgtgtccccagttgtggcaactgaaaatatctgcagacattgccaaatgtccccgaagggcaaaatcatcctggttgagaagtcagtgctacagagggattcttcacataccctgttcttaggtttcttactgctcttgcagcatggctgacttcttatcattttaacacctcagccagaactctgactataaacaacaacagcaaacattcttattgagtaggatgcccaaatttcaattcctgggcatttgcaatatggcttgtctcctacctggcatttactttttttaaatcctcattaagaagttgtaaacactaaatacattgctgttggcactaaaacaatgcttatacattcaacaaatacctaggagataggaagtaaggaaaggatcacattatattagccaattaaatcatccctttcttaacgaatcaagtcatctgttagaaagtaaatggtacaaagtaactgtgttaagagttatcaatgatcaattatttggaaataattcactcagagaccactaaacaggtctgaacagccatattacaaacaggaagaggctgatttgcttttcttataaaatgttgaggttctagaggtataaaacccattagactagacagaataattgtattcccattcgtacagactcattgcagagtagaaaatcaaatccttgggaatcagatgaagtatatcatagcattcttaattatttgggatctaaccagaatcattaaaatggtaaaaacaaaattatattttaaaagtacaaaaagaatttagttatgattatcatcagcatgggtttctcatctacacttcaacaatgagattaacactacatgaaacactggtctaatgctttacaagaaagagttaaacgtccctcaaaagcttcagataattacctaagccagaagcaagatgttagactaggcagactaatgatctgatctaggatggtaattcccatggttcctaaggagcacaagcatcaatcatttaataaatacatggtttccagtggactccagagtgggtgaaaaaaaatctcagcagtaagaaaatagtccaaattttcctggtgtatcaatatgtatgtcgcttaaagcaagtctatttctaacataacacatttctaatctttctttcatatgctattatattaattaatgcaagaatcagtgccagagggggaagtccccataaatggacaataaagtgatgggttttaacaagatctcgcaactctgcgttttgaataattataggcaaatatcctttttgatcataactacttcatttctttttaaaaaattatactgtagctgacttttctacctttccacctctcagataactatatcatggctttcaaaacccatggtctccagttatgaaacacctaagaagattccacttgactctaagtaagcctcagttggttaaacaattatccaaatctgagagatttttaatttcatttctgaattctcatatggtaatttttttcttttgttgtaaagttctatgaagttcaacaaatgtatacagattcatataactactaccataatcaggacaaaaaacaattctctcatctcccaaaagtcccttgggctaccccttacagtaataccctcaccacacccatatctctggccaccactggtctttttactgtctctatagtttttccttttccagaacgctacgcagttgcaatcatacaggatgtgtagcctttcatactggcttctctcactctgcatgtctgagaatcatccaagttgttgcatgtatcaatagtttgtccctttttacttctcaacactagtccacagtgtacttatccacactcttgatgaaggatatctgggttgtttccagtttttgactgtcacaaatgaagctactatgaatgttcattcttctaaaaatttttgttgaatataactttttatttctctaaggtaaacaacctggaccagggctgccagggcgtatgttaagtatatatataactttataagtaactgccaaactgttttccatagtgtatgtatacttttgcactcctaccagtaaaattctctaaaattgggttatataatgtgacagaggaagctgtaatggtcataaatgatttgtttatttctttttgtatctgtgctaactataaaatgtgctccatgctttttgggctattacgaagatcagaaccacactcattaattcaacaaatatttggcgagaactattatgctgggaatagtattaaatagaacaaatttggcctctggaatatatatatggagtgtgtgtgtgtgtgtgtgtgtgtgtgtgtgtgtgtaaaaacagtaatttattattacctgagtaatttttcattctaaggatgtatatagagtatattagctaaagatattttaggagaacttggccttgttttgatcaattctaggtacatctcataggaagcataaataaaaaacattaactatgctataattctgatttaataacaatgaaattaccaagtgttcctgagaaattggtacaaattagaaactaattaaaatataatacaaattttaataactgaacaagaaactttgattccaagatctagaaaaagcaaatttagaatgcagacagaatgagaactatgaaaggtactttaaaatatcaaaattcttttgataaatggagagagtatttgaatgtcatcaatggctaacactcaattcccctctctggctacacaacctcaccaagctcaatctcctccccaccttctttctctgaaagttcaccctcttgtccagattcccagtattccatctccttattaaggctcattctaggattttcattctctaattcctctggattgatgggtcactgcctcaagatcatacctgcagcttccaagtggaagacaatagcaccccccaaggattgaatctctccccagctcagactactagtttactgcaccccagcccctcatttgggtcatccagaagaggaatctgagattaatatctaacttgtgattcgccaaggaagggaaaataagccaaaaccattctgtatgcacttaacattgctttctttggtaaaatgcagcccattacctgaaaagcctctgaaatttgcagagaattaaaaaaccccatgcttatataaaaggctgagtcattttctaagagttaggcaagcaactcaaagagttcaactgctaacaagattgttcagaaatgaagtcgcctgaacataatcagtccaccctaattgattgcatacagttttattacataactgatggttctaaaccccagccaattagtttgtcaaacaaagattaaattcttgactggtttattcaagttaaatttaggaaggattcacaatagaacccaccttatcctggcagctgaaaatgtactctttaacaactaaaattattatgggactttcctataaccaaaaacagaaaaagagaaaagtttcattgagatataaattttgaataactaaaacattaactctgggttgtattttatctaatgcaatttcctttgctatatagtttcctaattttgagatctttttaaaaaaattttcatggtgagtatcactggtaatgccatattcgaaattattaaactagaattaagcaaaaaattagcctatttggcctgacattgattccaaagaatctcttaggctgcttgagtcattattgccagtcaatcattcacagatgtcaccaacttctaatgtttggtaaagagttaagtctgtccaaagattctgacatttatttctgagcatattcctcatagtagagccaagtcatttaaaataatcctcattataaatgctcatgtttacattgcatttttagcattccattagttaaattccagtatgataaagcaaaatattttcctaaaactgggcagctagagaaataaatcaattaaccagttttcattaagcacctgttattcattcagccctatgcaaagtaaaacaagatacaaaagaaggattagaaatagatataggtgagacacagaattcatgatttcaatgtccaggctagtgttaaatattgcattggaaagatttttagaaactaattttttctccaactttatataagtttatattagtattttatagtgcagaagtcagcaaaatttccataagagaccaaagagtaagaattttaggctttgtggccaagaggaaaaatcaaggatattatgtacacacttattaaaagagaaaattaatttccacatttttattgataaaattcaaaaattatatcatattaatcatatctcaaacaataaaatttgtggaagtaattactatgttttattttataagacctcaatacagaatagagaagtcattatacaagaaaactacttgcacacacatgtttatagcagcacaattcacaattgcaaaaatatggaaccagcccaaatgcccatcaatcgaatggataaaaatacatattattatatattatatatattatatgtataatatataatatattatatatattatacgtataatatataatatattatatatatgtcatggaatactactcagccatacaaaggaataaattagtggcatttgcagtaacctggatggaattggagactattattttaagtgaagtaactcaggaatggaaagccaaacattgtatgatctcactcataagtgggagctaagctatgaggatgcaaaggcgtaagaattaaacagtgtattttggcgactcaggggaaaagataggaggcaggtgaaagataaaagactacaaattgggttcagtgtacactgctcgggtgatgggtgcaccaaaatctcacaaatcacctctaaaggacttactcatgtaaccaaataccaactgttcctccaaataatgaaattaccaagtgtttctgagaaattggtacaaattagaaactaattaaaatataatacaaattttaataactgaacaagaaactttgattccaagatctagaaaaagcaaatttagaatgcagacagaatgagaactatgaaaggtactttaaaatatcaaaattcttttgataaatggagagagtatttgaatgtcatcaaataagaaattaaataataaattaataaatgcactgttaaaagagaaagaaaaaggaatagataattcaaatgtaccaaattttttctgggattcagaattatcagaaatcaatttttttttttttttttgcttgcggttaccttcaattaaataggtgttaagctttcctgtagtttgttctagataacaaggaaacaaagataaatggccccctgccctcaaagcactaaaatgtaagaggaaaagacaaatagacaaagcacaatgatggcatgtaatgtgtgctgcaataaatgtctgtatacagagtgctccataaacatttatagaaagtgctacataaacaaagatgaaggacttatgaaaatattgttgaaggtttatctaaaaaggtacatttctccccttgtggtcttagtaataaaaacgctgggccttcagagtgtctaattgattgaggatccttttgttgcttctgaatgatggttctgatctgttttcattatatattaatagctttatagtggtgggtgttccagtaatttgcttgaatcagaagggactgtgaggatacagtcaagaagtactttatttctatattttttttactaagtctatcacagtgcattttcttttctcctggcaattatgattctggttatttgagggctctagttaatggagaacttccccctagcagtctcaagcactaaaatgaggattgacaaaaaacaaacaaacaaaatccagattattcaatataattccaagccagaagaaggaggggaataactataattttattatctttttttaaaccagtgtgccatacagtaggcaatgaactaccaaagccacatacttattatctaaattcagaaggaaaccaaagtctcaagtctcctctctcccaaggaggtctgttgtaaactatgacctaaaatgtagcaacatgcctgattgatgacatattaaagaatcttgcaaacttttctcttcaaatatcaactacatgatgacttcagcatctccctgtactacaccaaaaggatgcagatggtacacattttgtgttttaattcctggaaagctcatctggaaataaacataaatataagtcaagatgctctactgttttggagggaatgcagaccattcacatttctgctccagtgatcctcatttgaagggtagctagtttatttccaaaagtctgttgctacctcagagtcacatcagccatgccaatactgacaggaggcactaatgagatcagaatagctacatcttctatctttctttatcctccctctgacaattttagtcaaccaacacctgtagaaagggagtttactctgcaatctcttctggcatgcaatctattttctagattggtaaataaagcatagacacccatcaaacgaaagacaaaaccagaataacatattgcccagaggtacagaggcctcaagcaacaagcagtgtttatcatactgcaaaggagagtggtacctgaaaaggagaccagagtcttgtgatagaggttagattacaaagcacatcaaatgttataccaatgaactgagattttcttctataagataaagggaagccagtacaagttttatacagacacttacataatcagattaacattttagaaaagagcacttctttctgtagactgtggaattatagacatttagactagtaaaagaagaacagtatttactgctatagctcaggtaaaagctcacaccaaagcagtagcaagaaaattaagaagaaaggatggatttagcagctattaagaagaagaactttgcaagtctttgtgactctgtgaaggatggaaccgagggaggtgcagtcaagggtgactactaatttgggagactgggtggagagtgtactgttgaaaataaggcattctaaaacaggtggaacagagatgttgtctaggtaaaatagttggatattcagatctggaggtagtggatgaagggtaagactaggttagagatagggatttgggatcttcatcacagacctgatagttgaaggcctgggctttgataagatcaggaggagaaaaattaagaggaaaaggagaaggcagttaaagacaaactttagagaatactaacattggaggtataggtagaagaggattcagagggagaatatgaagaggaggcaatgtctgaggtagtggtggctcccaaactcctatttcaaaaggactgagatcagcaatgaggtcagaagagggcttgaagatttgtttgcatagtagagtatttaatcaaataattgagaaaactcagttgtccatatcaaagaatgagggctgttgtggacattatgttcccaacccagctccacctttcagttactacagtaccgagaagtagaagaaccaggagagtgcactgccttgaaaaatcaaaggaggatgggattttaagaaccagggagtggacttggtgtcaaattccccagagatcataaagtaaggacaaaataccagtcaatttagcaatgactaatgtttgccagtgcaatttcagtgaagtgatgaggggaaaagcccatggcagtgaggagagggtgagtaagaggtaaggaagagtcaatgtgggcagacctctttaagaaatttgactatgaagcaatgaagaagaatatgacagtagctccagggggattctgggtcaaagagcctcaaaaatagtttgactgcacaagtagagaccctgtattagagctactcctcagaactccacgatacacctgcaatgccagcagcacagattgatgactgttcctctctggaaaatgtctctcccatagggccccatttccatctaaaagtccactaagattcatttagttggaccttaaaggctttttactgacagcaattttctattaaagtgcaaacatccagtaacaactggaaatgaggctaggatagatgcttgaagtagaaaggggaagtgataaagcaaaagccaaaaaataaaaattaaaaaaaatctttgcctgcttcatggtcatgggcagagaagggcaattgtgattaatcacaggtgctggctagctgaagttattctttatgtcttatatacagacaggcattatacacagagtatcaatttttagaatacaaattcaattaaataaacttaatactaatttggatgaaaattaagtctattcggtgatacagatagcatttacagatattaaatgccccagggtaaaacttatggagatcatttgtaattttccctaaatgtataatcatagaagtaaaggaaggacttgggaaaatcaaagcctgataatgattactaggtgactttcctctctcgaaattttttcacaattgaaacagctcattgataccgttgcctgttgtgtctgctgctgtctccatcccaatttctttcttctgatcataggtccacaggaacagtgttgttgacttacatattgaatgcagtcattcacaatttatgcatctgcaatctacatatggccctttatgcatgtaagaaactgaaaataatgcttccaacctgtctaagagatactgcagcccaagtaggcccttcctttctgctacaaattgaaaatcctttccccaccctgtcaaggataactttatatatatatcatctctaattctcccatggtaaaaaaaaaaaaagggtaacatgactaatgaaagagggaggtgaaagagggaaaggaggagcagcagaaggaggaggaacaagtggaagaggggtcagtaaatgccaaaactattttccatccattgaatcactgatactccacttccatccctaaactctgtcccattttgtcatctgtccattaacaccttttccctacagtcccatcccaagccaaattcttgtaatgaaatgtctagaaaagtgtgaatctgattctcctctgaaatattttgaattttactttaattctctggaaagccgacgaagtaccattagcttttatatgtgaggttgcctttctctaaagttgagctcagaccctggctctgatgatctgagatgtggcagtgttgctataagttgaactctcaaaattattgcaaaggatttgagaattcatatgctagccaagcattgtgtaaactggaaaaatattaatttgatgaatagatttctacactttttctttcaaatttgattatctgtgtggtgattactaaaacatgttcacttaaaagaattgctgaatatataagaattgctttatatcaatgtgtatatttataataatcaataaataagaaatcattgctaccatgacagcctgataagtttgttgacattaagtatgctggggagtgatttccaaattaaaaatgtgacactgtcccaagaaagaatgttgaactaaaaatggtatctgaaaataaatccatcagcatcttcactcatcctttctgctttcttttgcctcatttgatgttcctattcctgcaaaaggccctctagcctacagggtgactttttgcaactgtgaacaaggcacctccagtatgatgcatcccataccaggtgaacagagtacaggctggcctcattggcaaactcaatttcttccacctgtgctctgaaacccacatcctcccaatttatcaagaaatcttgctcccgtacttttactctaagtctactgacttatcctcatgaatattaaaacatgtctaagacctcctggatcttaacagatcctttccccaactccagctaccactctgtcctttttcctccaacctttcatacttgctagacttcttggtaaaatgttttactctcaccatccctacgtactcccacttacccccaacccattcccgtctgacttccagccatgccacttctctgaaactgcttgtatcaagattatcaataaagtctatattatcagatccaataatttcttctcaggactcattttttccctagttgaaggatttgatactgtatcatcccacccaccttggaatgcttttattctgtgaatttggtgactctaaaattaccctgtattcctcctatatgtctgtctactccttctcaatatgctttgtgagatcgtccttgtctagtcattccttcaacattggggggctcttattctgcacacataattttattctgtccctgagccttggttacatctacagggtgatcctcaaatctttgacctgtcatgtaaacttcagaactgcatatttaattccttaaagggcatcaccacttggatgactatcatatacctcatattcaatatgtctaaaactgaattcttcaaatctgcttctcctgcaggattctcccagtacatggcaccaccagccactcagttgtttaaggagcaacctcaaagtcatccctccctcctcctctcttttcctcatctcttacctctaatcaatcaagaagtccagctaatttcacttcacaaatctcactggaatccatgtatttctcatgtaatcatcctcatcatttgctgcctcattatctcctatgtcattattctgtactgaacttgctgatttatctcttgtccctatccaatctattctctgcaacacagtcagaatactcttttaaacatgcaggtctaatcatgatatttcctcatttaaaatcctttatgaatgtgttactgcccttagaatcaagtcccaactccttaacatgggttattatatattctgggaactgagatttcatgttccaatatcatcttggtccattctccagccaggttggacttcttttcatttgttaaagatacaacacagtctctaatctatgggcttttgcacagattgtcccaccatctcatgtactttttccaacaactctttctatacaatgataacttgtctttcaaatctcaacctccatatcacttgctccaagaagatttcccttctctcctaaatcaaatattgacaaactatgacccatagggccaatttgcccatggcttgttatgaaacagccctcaggctaagaatggttttaaacttctaaaaggatattaaaagaaaaagaagaaaaagagaaaaagaacaggaggagaaagggaagaaagagcaggagaaggagaaatgaagaccatttatggcccttctagcccaaaacagttgcctttaaaaactaaaatatttactatctgacccttttcagaaaagtttgctaactcctgccttagatcataagcataggtccccctactacgtgctcccttgatgccctgaactttcctggttatcacatttgtgctttgtattacaatcagttttttaatgtctcattttcacactagactatgagctcttcaaagtcaagcaccatgttcacctttatcacactacattccaagtatgttgtacctggtagagtctcagtaaacatttgttgaatgaaccaaaatgaaaatgaaaacaaatgacagcttccatattgctggtgtccacaaaaaggccatggaaacacttccaggggtgtatgactaggacaaccacacatccccatgtttttcagggcagtgatgatttattcttgttgtcccagcaaaattattaactgttttccctttccctctcaagagtatctcacttcggaggaagttaggatactcggaaaaagttcttaagcccaacccctgggaagattttctagagaccattgttgcagaaatgatagtgatctttgtatcaaaagacagcactctttctatgggaaaaagaatcattgtaacacatactgttcagaatccagaaaaatattagtaaaatgtgtttatggaatattatgattgaaatagacttttgttcactgacgtaaaggttttcctatgatttttaacatggtcattgtgtgaaatacattgcaaataaccaacttttataaatccatcttgagtttggaacagtcaatataattacatttaatgaataaatacacagtaagtttttttgtgtgtacctgacatctatgctttagtcattttttttttttttttacataactgacaaaacagatattctagctagtcaatgtgcaggactgatttaaaaggaattggctgggcacggtggctcatgcctgtaatcccagcactttgggaggccgaggagggcggatcacctgaagtcgggagatcaagaccatcctagccaacatggtgaaaccccatctgtactaaaaatacaaaaaattagccgggcatggtggcggctgcctgtaatcccagctactcgggaagctgaggcgggagaattgcttgaccccgggaggcagaggttcccgtgagccaagatggcaccactgcactccagcctgagcgacagagcaagactccatctcaaccaaaaaaaaattattttcagatatagaattgaattaaagttcagtttgggaatcttctggctcaacattcctattttatggatataaatatggatgacaagagaggcaaatattcctgcagtggataaggctcctttgaaatcatcaatagtcctggttgaacatttttccataaatgtaaataaaattaaacataaaatatcatatttatattgcattcctttttttaatgactttgaaatcactttggaatcttcacgtctcagattcacctaacagaaatctatattgtacttatttatacatgaatcttagctatccaatggaagatatgagttctacatcttttaatttccttttcacttctctaaatagtgttttgccaccactgttctgggacccaggccaaactcattaaacatatatatctattactaataatatattatttgaatatgtgttgaatatacactcaatactcaatataaaatttgaatacttattgaatatatgcaacatattaggcagtaatcttatgtaatgtttttactcatcacaaaaaccaaatgaggtaagcgccatctataaaaatgagaagactgaggctaggagcaaataacttgcctagagatacacagctagtatgtgcaacagatgggatctcaattcagatctttctgagttgactatgaacaacaatactatcataaccatttccttaggaggctgtatcaggtacctcttgtgtgctacttcaaatcttcttggtctcatcttttactttagccactgatgaggctcccagttccatgcaggaggaagctaacagtgtcctgccttctgccccaggcctctctgatgttactgcatgagatgaaccacttagcattcatacgtgtgcaaccaagaagtgttggtgttggggatactttaaccaatcagagacaggaacctgtcccttctcctttttcccatgggcagtgttgggataaatttcataaggatcctgagaaagcctcacaagatcagtatttcctgtaggcatcctgagttgccttccctccttctttgtttcactaatgcagtcccccactcctgttccctggaaccatctcccaaataaataacctatacgcaagtctttgtcccaggctctgttttcagtggcattcaggacaagaagaagccatttccctcaccagctgaaatcatcttgtctctatccctgagctttatggaactaatatgcagcagctaatatattttatctgaagaggaaatcccctgtctccgatggacctgacttcttcatttcctgtgaatagcagagctatctgcatctgtagggtctcaggaccatgttgagaatatttgtctacctctgctggaagcccttctgattagtcaggctccttgagttggaaacataaggatttataatgaaaaagagtcacacagtaaaaacagaaagaatgaaaagaaaacaaaccaataaagaacctatcctatcataacatttgaggttctggtatttgctggctttggagggagttcaaaataaatgaaagaaatgtgtattttattaaatgctaatatttagaagatgtggtggaaaaaagaaagataaatgtttccaatcatatttgcaaatatgaggcatctcctacccctttcacaatggttaggtattttccttgcatttgagcaacctacatggttttggaagtaatgcctggaactagccaaaaaaattgtactaggagtagcatgtgaatctaaccaacagagattgcaccacattatgctctcagcctagatcacagtaaaataataagctttatctagtcgagttgtagctgccacccaacttcctccacagaaagggcctattgcttctgactccacatagaccagtctataataaactctatcctttccttgcaacatctgctgtcgttaacatgatctctgtttgtcttgaagtataaataggccccaaatttcaaaagttcagaacacactgaaccgtaaccacatagcttcttccttttcttcttggtaagagccttatccctctcttgggttttggaattcattttaaaaacaacaatgaaataaagtggagaggaagaagatttggagggtcagaagtactcaagggggtcagaaatgaagacttccctttgtttttgtttttagtatttttgtaataatacaggttgaccatgaatttaaaccatttcttgtatacccttttatccatactaaagtgaggagtttatcatcaatataagtcaaaagaagaaactaattttaatattgattatttttattcagtactcaaagtggtttacaaggttcagatataccatttgttttattttgcttgaacaaaacatttgtaattaatgcacttctttcaaaaagagaaaacaggtgattcttatctttcctctgatgtagggtattgataaagggcaaagcactgaggcctgacagccctgtattaccagcctagccctgcgatcaagcaaattgacttcacatctctgaaattcaacttactcctctaaaacgtggatgaaatcagtaatattttcatagtactgttaaagtagtagatgcaataatgcatgtgaaatgtttgatatgtgtgtttaataaataatagataatgattttccaaaggcataattggatcttccaatgtgactgacaaagctttatgatccagttatctaactaaatcagatatagacggaaatcagtttcatatgtatctccagctgagaggttaaaacagataaaatgattagaagagtatctagcaggttgtaaacacttgataaatgttagctattcatcactatcattattaatatatcattaataatgtataattattcatattattgtaatcagtttactgaatggcctgggctcagcaggtgcaagagaggaaatttagtctttctaaccaattcgtatttaactcatactgtcaaatgatttttcttagatcctggataaaactctaagcagatgacataacttttttgaatactttcaaatatgaaaaattccagtgcaatctaatgcaatctcaaatccttttgaaaatttcttccttccctcagcccaagcctgcctcaggctggaaaatctgtgatggggaaaaaaagtttggttggctttggatcattttccttgactcctcctcctctactcactatgaagcctctggttctccagggttgagcatagggcctggagttgagagagggaagggcaatgtaagacagaaaagatctgccgtgagtaagaacattgataatctagctttgatttttgcagatttatatctagctttgattttttgtgagttttgcagatatctgaaactgactccttttggagtcaggcccttctgcaggttctgcagagatttacactcaagatatgcagctgcttgcctggcatggacaatacctgttccttctggctatttaagatttctctggtagactctagtgtccaagttcaaccctgcacttgaggtcacctcactcctcttgtatgggtctctgttaaaatgagccatgatacactcccctaacagacacatatctggtctacagttggccaggtatctttgctcagaaagctgagcaaagtggaaccctctttagcacaactagtctctcacctgtagactcttcttcttcaggaattgcatcagacaattcctgtctatctgtaaactccttagtggtgctttaaagaaaaattcattggtgtgagatatgagggcaagcactatgctcttcctcatcatagaagagatgaagaattcataacacattgagaaaaaaaaattggccaggaacagtggctcaggcctgtaatcccagcactttgggaggccgaggtgggcgaatcacgagatcaggagttcgagaccagcctggccaatatagtgaaaccccatctctatgaaaaatacaaaaattagccaggtgtggtggcacacgccagtagttccacctactcgggaggctgaggcaggagagttgcttgaacccaggaggcgaaggttgcagtgagctgagatcgtgccattgcactctagcctgggtgacagagtgagactccatttcaaaaaaaaaaaattgtctacagatgattctcataacagtcctcttctaccttccaatgaacactcacctttcttacataccatggaagtgcatgacgggccagatgagcagaagccacactaagttttaaccacttcctttgcaagatcattataagtggtcttagtttacactgtccaacacagtagccacttaccgtatatggctatgtaaatttaaattttaataaaaataaaataaatgattcagttcctcgatctcattagtcctatttcacatgctcaatacctacctgtggctagcaggctaccatattggatagaaccaatatagaacgttccatcactgtaaaaagatacacaggcagagccagaactctggaacctcacttcagaaggtgaatgttttgttatctatttttttgttcccagatcttctcagatcttgggccctctgttgaagtttcaataccagaggaaaaaaatcacatttaccaatctgttacatagtaagtaaagttttagcatctgagttctggctaggaatatgtctgaacacatgaatacaagaccattttcacaattatttccaatattttattggaattttcacaaattccaataaaatattggaaataattaattagaattattaagattgagccttaagtctaaaaaaagtccactccggcagagtaaccatctccatccttcctaaccccatgacggaacacagaagagcctctaccaaagctagtctcctttatacttgtggtctttcctagtttaggaattgtctctcttttttttctgaaagcaacttccaaaactaggcagaacagttattatcatgcccatttttccaatgaggaaatggactcagggagcataaatgaacttgcccaagtttacagagccagtaactgggaaagtcaggtattcccaactcccctccttcattatgcttcttcctgaaaagcaggaaaaattcaaaatataaattccttctaacatgcagagaaagcaggaattcaaaattgaaccactgtcaaaggccaccgcaattttgatttatcactcatgtatattcttccagatacctagtatgcctagaattaaaattaaaggctattttattagcaaagtattgagaacaacctggtctgatgaagaccatgaaacacacactagagcctttccatgtccctgaacaaaattgggaaatgggttttggtctttttgagcacatttctgctttgtctttttgtatcttcatgtcatttactcaacaacattaacagagtcagtgcccaccacttgggaggacatgggaagaaatgtagcacctactagaaagagacatttaaacacagattagggtgaggaatgtcaccgacactgatactcatctacacagaggagctgtttgttcatgtttttgtaaccaggcttaacaaagaagaaaaataagaagaaatgcataggaatgagaaacagcaaattcaagacagttatatctgagaaaggacagggaaggaaattcaaatggagtccggaagcccagagtccagaagtccaaactgtcttcagaagttgggaaagttttacttctagagatggatactggctatgtgggtgttcattatactattaaaaagtggaattcttcaaaatcaattttaaaaaaatttaaaaagttactaaaggcacatttgctaaaacagattatttctgcagttcttttggtctcatttgttgaaagaaaattgtacttgtagtgtttgaagtatttttgtataataaggccaagagaagaccaaaagctagaatgttctgtgaataaggctggctttgcctagatgtactaataaaagagagatgtgaaattaaaataatattcatttagcttaaccccagccttcatatgagtcattagcacactcttgatctaggtggaggagctaaggggacataaatcaattatctgaaaatattacaaaagcattatcaactttaaaaagctttcaaaattgtaaatacacaaatgtaatacaatggtttaggttcattaataggcagaggcaccaagaaggggtgcccattctcacttcagggtcacaaaaggcttcatagagtccctcccttagtgggccttaagtgctgattagagtcctgcgtgttgtgtagccactgcttggctgccccacatgtctttgctcccctttcttctggttatggatcctgacctctggccacaagagtatatgtataactgagttccagccagtcatattcccttattccattggactcagggattggtcctgaagtgggtgtaacagccaaagagaatttatcagtatttccctgggcctgatatatagacatcaggagaaaaaaattctttgtcacctgagatgactaaactgggtttactgaggcagtaccatcacccccctccaaccacatgtaggataagccctttgacagcagaaggaaataaggccaagagtcataaggagcagaggcaagcagaaaagaaaaagagagagggcaaatagcattgaacccttgacactaatcctggtagtccaaggccatggttcttccagctccttcttcaactgtgttaggtgttgcactatccttcccagaggcacaagccaaatacttatgtgttgcttaaggttcttagagttgtgactctcttccttgtcctgattaatgcagtcactaactacattacgacattccagtcaacaatggactccaatggctcacgcctgtaatcccaacattttgggaggccaaggcaggcggatcacttgaggtcaagagttcgagaacagcctggccaacatggcaaaaccctgtctttactaaaaaaacaaaaattagctgggcatggtggtgtgtgcctgtaatcccagctactcaggaggctgagggagaaggatttcttgaacccaggaggcagagattgcagtgagctgagatcatgccactgcattccagtctgggggtcgagagcaaaactctgtctcaaaaaaaaaaaaaatggactgcatatatgatgatggtcccaaaagattaaaatactgtaattttataatactatatttactgtgttctatgtttagataaacaaatatcattgtgttatagttgcctacagtattcagtacagtaatatgctgtggtgcaggtttgtaacccaggagcaatagctatgccatatagcccaggtttggagcaggctgcaccatctaggtttgcctaagtacactgtatgatgctaacacaatgattaaataatctaatgacacactcctcagaacatatcaccattgttaagcaacatatgactgtattttgagtaagcaatccgtcaataggcagggaaaggaaggagacactgggaagagagtggaagggacacaggcatgaaggtatgaaatagtgttagagaagaaggtagcctgagttcaaaaagatggatctcttaaaaaataaagccagtgacgtaggcaaaggccaagccaagaagaccttgttttgccttgaccctcatcacaagtatcttccacttgagtctcatttccaaaaggcctttctctcaacacagtattccagcatagacacctttggctaaggaagccttgctaaatggttttattctaatggttaacaacttttgcttcatctcagatcactgacattttcataatggtctgctcaagacaaaacaattttttaatatacgtaatggatcaatcttttctgttggaacttaaggcctgagggcaggtgagctgattagacattgcaggggaaaaagcacttcccttatcccttcaaatcatgccctgtggaccacggtttactaggcctacaagccagtcttactttctctctctgactgctctttcactgtgtccaatttgccacattatcccaatgaggggtggcgttctcctgtgtcctagaaaccttaagcacacttattctatcatgattatttctcctgggaaaagaaaatgtggaaaatgtgtcttacgtttcaactaaatcacaaaatactgtcacagcctataaatgtgagttgtcactattgcgtaggaggtataatttctaaagggtacatagaaatatttagaattccttttcattgtatctacttcaagtttaagcaatcaggatattactgatgagatctgaagttgggcacagagagattataccactatactatgtcacattcattaaataacttgtactatttgttatctgatctatagataaatagagatggtctcaatgaaagtgatttatgatatttccagtttctttcacataaaatggaataactataaatggagatataatcaaataaaaaagcatggaaatgacatttaaatttgataatgcaatttgatgtgatcatatgtgcaagtatactgcatcaagacaaaaggaaataccagagcaatcatcatgcgttcagagtttatttcacatttatgttgtaagaaattatcatttaagtacctataatatggcacaggggttatatatttttgtacttaaactgttttgatatttcatggctttatttaattcagaatatagtccacacaggcttgggaacaacatcctagctggctaggatgtctggatactaatatattaacatgacagcttcatgaaaatatacaagaaacagccaattttaagtgcatatataaatatatttagtttgaatatcaactattaaagcttctaaaacaagcagtgtagtataataaagagtgtgccaaattaagagttagatcatgtttaagacaattttttttttcttgagacagggtctcactctgttgctcaggctagagtgcagtggcacaatcacggctcactgcagccttgacctcctgggctccagcaatcctctcacctcaggtaggcaatccttcttatggtcaaaaaggaaatcacttagtacagggtttctcacccttgcctattgacattttgtactggatgattatcggttgaaaggtgctatactgtgcattgtaggatgttttacagccttcctggtctctacccactacatgccagtagcacccctccagttgggacaaacaaaaatgtcatcaaatactgccaaacttcccctggcagcaaaattaatcattgacagcctctccccacattgagaaacactgacttggagaggttttatgagaccccaaatgtgttactgtttttataagttgtaaattatcttacaaatatgttatctctttatacaatgactaattttccaatctataatttgacaaattatattatatattgtacaataaatggcactgctttctaatagcaaaaactttattatgctgttggcaaaatttataaacaaagcaaggtctggcagctcttcaaaaacaggatcattctttattcacatttttttagccccagcacctaatacatttcctgacatatatgccatgtctccataaatcttttgtgaatgaaaaagaaagtcttaaaagagattttactatgcatatttttaagaatgctttaactttaataggtaccaatgaattacacatagttggcagtctaaccactaaaaaagctttcagatgtgtgtgcatggaggcagggtaaagggggcacattgcaaaatggcaaaaaatatcctaaatcaattctattatccattatgcttttctatcttgtgtgaaatattttcaaaatttcagaaaattaacaaaatcttcactgctaccagagtaatcaacatcaccaccatggatcactgagatagaactgctaattcagctctctcttacccactcttgcaaaccttccagagttttaaaaatgagaagtaagttatatcagtctcctctgcaaagaaaaaaggaaaatctcattttcttcaaatgtcccacagggctcctcaggaaccaactctcatccacatatccagcctcatctcaggctgctcatttgcacggcacccttgttcagtccctacagcctgctttcctccagtgcccaggctctttcttacttggggtttccacacagactgctcactcagctgtgagtggaagtggaaagcgtttccctccatgctttttctggccaactcttactcaattttggtttcagtttaaacgcacttccaagagccacctgccttgacaactcacattgtccccaccaccactattctaaattttgatgcacttatagcactcctatttttttttcattatatagcatttatcatatttaggatattattcatatatacctatttacctatttataattatacatttgtgtgtgtatgtatatgtgtgtgtgtgtgtgtgtgtgtgtgtgtgtgtgtatatatatacaatttatctctttttgttgattctccctaataagaaatgagggcagagattatgtcattttgtacatacagcatttattacaatacttggcatacagtaaatgcccaataagtatctgttgaagaaatgagttaataaatgagtaaatgtcacattgactttatgaaggaaaagatctggcagcaaaggtagcaattttaggatagaaaggaaatgataacatgggtaagggaagtatttgagggtcaataaggctctgggggaaccaattcctcaaatcacactgtatctgtaactatttcctccatcagtgcacaagaatggcacactgttccaataatggaacactgggcacatgggagttatttatatcctactgcttaaggtcatggccaaggtctgattttgcaattcaaaaaattgcaacctccagcataaatgggttatctttaccacaccaatattcttggtaataaacttacatttatgttctttctttaccaatattattaacaataacccactattattggtatattagtattagtatattattgataatatacctatattattatattattaatataccaataataatatattaatatgccaataataataatatctcaatataattggtaaagaagagagaaataaaataaggcttctctaccatattatttcacctatcactttattccagataatttatatctagctgcaatttatctccaaagctctaattccaaagatttcaacaccaccaatttaatatctgaattgctcctctctcatatagtgggtaccccaaactcactaaaggcaaagcttaagcaaccatcctcttctttcctactcccccatatctgctactggaacttccattcccaaagatatcctgactacggacaatggtgtcactgttgacaccctctccacagtccccaaagtcaggagtaagcaaactctatttcctctcttttgtatttctttgatctgtaccatcctctccattctggctgccatcaatctcctcccagtcctcaatcaatttcttctcaatttgaacaattgaaacagtgtcttaacaagtctttccatttggtccatgctccaacccattcttcaccctgcttcctgctgcctcattaatctttcaaagttcagcttcctgcaggctcctcctctattctgaaatcttcaaagcctgctcagtggttactgaagtaaacagaagtactttagtcagacattgaaggctctccaaaaatatgtctccacccttcttttcttctcggcatgctttccacattgcatccaaatgaaaataccccacaccttgtaatatccgagctctttactcatgcccgccctcagtgtggagggtccttttctccttctgccaaaatcccactaacttggagctctcagagtacagattatacatttctaggtgcttatcttacattgctttatattacagttggttacttggattttccttcttactgaattgttatttctttgaggttcaaggttgcgtctcacttatgtctaaactccccagaaagcttatataaacgaaagtttgcacattaagaaaaagcatgggccctgaattcagatggacttgaatgcaaagcctggctttatcacttgatataaaaaagcaaaggccctaaactctgtgagcattggtttcatcatatttagaattgattaaccagaggcttattttccaagttattgtaaagacctgatccgtaaagcatataacacaatgcaggcatgcaagaggcacccagtaaatgggagctattggaatagtagtaactattaccacattgtaatatataatcaatatatattggttaaattaaactaaaattaacataataaatctttcctgccctccaggaggatataatctaattggggaaagccacatgctaatgtaattaaccattctaagtaaaatgtaacatgaatgaatggaatcagctgtaagttccaaggttatgtgaagagaaagactgacttcctctcagggtggagaagacgtcccatgaaaaaaacacaggacctctgcaaagtctcctgcaacagggaaccaccacagaaataggcctgctctgaacaataaagggtcattctcatttgttttcatttttgttttcaaattaggcatgttttaaatgagtcattaatcatgtacttacttcactaattactcatttcttttctagctaattttttattgaaaggcatcctaaaacagggagaaaagatattgtcttgaaaaagagaataaaagtctgctcagaatcacatctcagttttttctctaagaccaagtgtcagaatctgatgtgatagtctatatgatcttaaaggtgtccttttgctcttgggacctctgtgatgtcagctccaacatggaaaatacaggaaacagctaggaaagactgtagtgatgagtcccattttcaacagattccaagtgcacacatatggtcagtctaaatagctttctccttaacacaaacagagaaaaccttgttagtgctcaacctcctgcactattcattccccaacatgcgtgatcctgtttggagttgggaatgtagggaatctggcctttctaattacctgggtactgtcacacagatcaatgtcagagtatataccataagactattgactattgaagaacaattcatggtaagtaaagtaattttaagaaagctgggaaaatgaattattgaaaatttcaaagtgtgataacacaactaactccaaaacaggaagtgaaaacaagattaaaataaaaattgatggtgaaatgttattttggactagttatgtgtgggttaccaagagtgatttaagatattttctttcctctttctccatctctctcaaaaggagaaaggcgaaagaaaacatcttaaatcaccaggtctgggctttccagatgtaattccagaaagagagaaagacagagagagagtttgggtacatagaatggtaccccaaagtatggtatgatgctttggcatactgagcacttttgaattaaaataaattgaaaagccttagaaactgcctcagaaccagggactttctaagcttctcttatttctaccacctccccaacaagtgtagaaaggtatttgctctggtatctgagtgaagaaaccttcttccaaaagaaatgcaattgtcttaagatcccctttctaagaatcttatcaactaatcaggaaaaattaaccaccagagaagagactaaaaattgtcatatgcccacaaaaccttttcacctattcttctgagggcagctgcaaaagattacctgagagactgtatctgcataataagacaacctatgttcacagtgtactttctcccctcaccttcttataacttgtccaaagactattgtttgtccttaggtcccattcagtgttcaaagggagtgatttgcaaacaattatctagtctttgagaccacgtactccccctagaaatcatttactactcctctaaactgcctatagcccctcataccactctttcctataaagaaggtatttaagccataatcatctggcccttctttgaatctgatattctctatggctcccactcttacacacattaataaatttgcatgccgtttgtcctgttgatctatttattgtcagctcacctcagtagactggagccttcagaggaggaagaaaaaatctctgcactctactattactatctatctatctatccatctatctaatctatctatatcttgaaatcttggaatcactgtgtatgttagtctgaataatgaccctaagatggccatgtcctaaacatcagtatctatgaatgttatcttatatagaaaaggggactttgcagacataattaagttaaggatcttgagtgaggagtgtatcatggattatctagttggtaaatgtaatcacaagtgtccttataagaaggagtcctagggatatttgactacagtaaacgagaaggcaatacaatcacagagacagaaattaaagtgatgcagtgaccatgctaacagcaaggggtgaactagatagcaaaaaattttaatcatgcagtgaaggaagttaggacaacccctagctgtgaggttataggaagaaaagggtcaaagagaggaactactacaaatgcacctttatgccatgtggctcagatcttcttggttggagcttttagtaataaaaaagttaaagtaggtccagaaataaggagaagctgttcaaaatgagtcaggctgctggaaaacagaggggggttcctgtgatccctctgtgtccctgcagtgggaaggaccctcgccccaggctggtgaaggtgcctagctgtgtgacatgattggcatccccagtgtgggaccatgtaaaacctacgtatctggaataaggcctctggatcttttttaaacaggactgaacaattgctccttgttttgaaaaacttttctgttgctgttggtattttcatgtccaaggcaaacagagagtcatgtggatgctcagaaattgaaaccttgcccctgttttggaagagatgtgtttcagcctgtccttcaaagggatttctcaccatgcaacctattatgttcatattttatttggaaaaatggagagaaagagaagaggaaatgcaaagaagaaggaaaggaaacagaagtatgggagcaagaaagtccaagaaagaaagagaccatcgggtgcttgtgcatgactgtctttcatatggaattaatggtggtttaatggggtatgaaaggatgttttactggaaacaacgaggaacaattgtctagctcacgtttcatttcacaggtcattattgcattaagaagtaaatcgaccaagtctggtaaataacagtctgtgtattgccgagagcttcaaaccaacaattttagccatcacaaactaatatctctgtcattttaacccttgcagggttgtgctagggggctaaacaattacagtcttcacccagttctagaaggtgagcataattcattgcccttctagtcccttcttttgcaaaacccaggaggccatattttagcattgttgttttgttgatgagccagccttagccaaatgcagctctggtggccttgaaaaacaacccccattttagtgagtgctgcaggcatctttaaacacactgcttcctctgcaaaattaattgctgcaaaatgcagtgctccctcatctaagcttttgcaagctcaaactcagctatttgggtaggtcatagatgtgtctgagagatccagggtaaatgagctgcttttctttattatagaagttcacgttcatgtcaccaaacattatcaggcactggacatacaggagtttctaatgcttaaattccggttccattaactcaggggcaattggtggatgaggccaatcctggccgtattttgaagcagttgtgtagtaaataaacacatcaaagagagtttattgtaaacaatcatacttaaaatacatatggtaaaataaagtgcatattaaaataaaattttcttgcttcaacttgggacaaaaatgtcaaagacaaaccaggctatactggccccgcaggaactggtcttaatcacctcttttctgccatcctatccatccttttacatctcttggtataccccacatgaactgacctctgttccctctaagttcccattaccgcttcatccccctccagcttcctgggccagccccatatgaactgtcaacatttcctcataatttttcaatcaaaaactgatgtttatcctacagagtggatatggaattctccacacttccacagtacctctaaaatgtggtaagtaaggtctaatttctttcttgaaagagaaaaaatcttgcagagatggcatcagtattccaatgtcttactttttttatttcaactaagactaaggtcttacaaataactatggtgtgctgaataatagcctccctaggatgcttatgccctaatcctgattatgtgaatatggcaagggactttgaagatattattaagtgtatagatcttaaagtaggaagactatcctggactataaaccttagaagcagagaactttctctggctagaattagagagttgtagtaaaggagaaggcgggagagattcaaagcatgagaggcacacaattagctattgctgattttgaagatgaagacagccgcaagtcagggaatgcaggcagccctagaagttgagcatgaagcctggcctacagtgaacaaggacacagcaaccataactgagcagcttagcagctgagcctcaaactgcattttaaacttttttttcttattttccttttcctcttttctcttccagtctcgggataaaattttgagacaaactgcatatgttactgatggaaggtatccgagttaccagcagtaaatctgtgtgggtccgcagcaacctcaatttctgcctcctcagatgaaagaacttgacagagggatataaggcagaaaaagagaccgagacaagtttcagagcaggtgaggaagtatattttaaaaggctttggaacaggagagaaaggaaagtacgcttgatagagatccaagtgggtgacttgaagaacaagtgtggtgtttcactgttaactgtgatactaggactttacagggtggcccccttctggcgtctttaaaccccttctcatgattcttcccttagggtggtctgcccacatatgcagtgccctccttacccttgggaggtgagcatgcacagtgtgttaaggaaactgtatgcatgcccatctgaggctttcttccctttgctgctggtgtgcccctggaaaggcaaactctgccatttttgtctcttagtgcatatgcccaggaagttgcttcttcctggcgtctccattcaattaacacttcagtgcaacaggtgtggcccatcaggaaatggcctcttcctggcaccatctgccaatctgtcacttttagggaggcaatgtgataattgccaaaccatcactcaacattcctagtgggtaggggagagccctcttctgccctactctatgcctgtctaacaacctataacacatctatgtaacctctcatattaaaatacagcctcagtatgtgctgtgaatctcaattccttttccttctccatacaatactcccatgccttatgcacatttatttacctaaatgcttgtcaagcacgcaccatgctttcttatctggtcatatatttccttatatactttaggagtcagatcctgatagtgacaaggcacctctggaattctctctctaacaaaagattgcttaaagatggaacccactcccagatgatgagtgactacaaaattgactgaaagtaatttataacctggcagggtctacgatggcagcatcccctttgccaaataggacaactgttcaagaggggccactggagcaagtcacgctaccttatacctctcagcccccacacttcttctgcattccaaatctttcctttaaaaacctctgtggaattgaataggggaactgaagagtggaattgctttctactcttcccctgctagcatggataataaaccaattttgcttccttttatcacaacttattattttgacttcttttcataagcagtgagcagccggactctttggccggttacacgaccacagtcctacaactacatggaactgaatctggccaagaacctgagtgagactgaaggtgaaatcatctccagaaactccagaaagaaacacaatcctgccattacctgaattttggccatcagagatctgaagcagagaaaatagccaagttcaccagacttctgacctacaaaactgtgagataatacttaggtgttgtttgaagccactacattgttaataatttgttatagcagcaatagaaaacttgtacaaaaaccaggatgtcatgctcaaatgttcatcaccattccaaccaggatcatgataagtggtggcagtggtggcaatggaatggaatagtcaagttatttagtgcttatcctatgacaggcctggggccaagttttttatatgcattttgtctacaaaattataaagctctaagatttcctttgtctgtaacgtgttcaaacagaaagacagtatatagcctacagatatggataggctggtttccacatgggcagtgcccaagaaaggttgcatcctaccaatatcacccaaaagggaagagattattattcatagccatattaaaaaatggcttcaactcccttccttcatggcaatgactttcaagaacttacattcagtttttattaatatttctcctgtgaggaagctaatcaaattgaaattcagtcatactggaagtccttaattctgtagtagaaagattggcttctaggtctaggaaaatttcttttctttggtgttcttttccttgacacactttacataataaccaactcatgtttcaagattctagttttccatataaatgagttatactatcattattcttactataaaaactaaattatacatacacatttttttaatggcaaccttctagtttttccctctgagtagtagtgctgaagatcaagatagcagaggggtaagaggcatgatatattttctttttcattttctgttttactgttttatttattcattcaacaaaaatctctaggataatgtcttaaaagtgaagttgctaagtcagaagtacagagctttaggtggtagccagatgacaaaaagctaagaaaagtgatatttgagaacgaagtttgagaactctttctccacattttccccaacactgcaaattatcacactttttaattattgcaaatatgattgggaaaataataataattatagtagcagtggtcattattgccttagaagtggtggaaatctttattaggtttatctttttaatccttataataatcatttgagtacataatattaatatctccaagtcctaaatttaaaaactgaggcataaaggagatgagcaacttgcttacaattgcacatctggttagtggacacaatccaagcagctggactcagtgcaagaactcttaacctgtgctttgattgtgagaaaactttggctttttgtatgtttattgatatttgtttcatttctctgtaaaatgtttcttggaattctttgcaaattttttcagttggtttgttcctttttgttcttaaatattagtaagttgtttttacattgatgaaattagccctttgctagatgagttgcaaatttatttctagttttttagttttgcttttaatattctttaagaagttttaattcttttatattcaaatttttaaatctacccacgtattttctagattttgattcatgcaaagaagtatccctgtaactctaaataacgtcatcaatattttctagtaattccatggggttttccatctttaatccatttaaaatttatttttgtaaagaaaaagataaaaatttctgaattgttttttctccctacatgatgagtcaaatggctcaacgttgctatttgaatgatttctattttcccataatttaaaatgctatttttgttataaactaaattgtcaaatgcatctgaatctatttccgacttttagaagtttattccatcaacatatttatttctagaatatttttaatgaatgcttccaattgtcagaaactaagattactttttacatctcatgaaaatgtaaatacataaagaaaaaactgtaaaccagacaagcgaatttttcagacccataatattgagatgagaatttgcttagtacttatttatgagctggtttggtatctattggcaaggcacaagcattttatttattggagggactgctcaagtattcccttccattaaaatgtgcatatatgcatacacatgaaaatataaaaataatgaaactgaaaatagacaaacattcatccattcatcttaggcataaaataagctcaggtttgagattctaccttctaaatttttgagaggttgaagggagggaagagggtctcactctgtcacccacgctggagtgcagtggcataatcatggctcacttcagccttgacctctcaggctcaggtgatcctcttacctcagcctcccaagtagctggtattataggtgtgcaccaccacacctggctaatactttttgttaaatttttcaatactattgtactgaaaggattaaagcagcaacgcagggttactccattattaaaacttgaagactaggaacacagcttactagtcaatgaagtccttgaaataatatgggaaaaaaagagaaaaaagaaataaactaaaataaaaagaaatagaaaatacagagccagtttattattatggcaaaaaaatcaagtaatttcatttacagataggtattcaaaaatagctcctcttgtggaacactgatattactgcttttcaaacatacaataaaacagagaaatgtgaatagatttctcataaaggattgttaacttgagtagtaaaattctcagtctcagaaaatcttgatgctttggttggaggcttgagtatttaaataatacctcctgcaaatggcaggtaatccaagtctagacaagctttgttttttaattgactgaattatatgcccaggatcaattaggtgctctctagattggtttctaattctgtgattcatttctaatcctaggaacccaggctacatctgatgaccactgacttataaaagggtaatttaccagggataaatagagtctactacatggcttaaaaaatcaattctctttaatgtgtatccctcagaacaaaggaagaaaaatatccatatgatgaatgcagctacatgtagctatttagtctttgaaatgtgactagtgcacccaaggagctaagcttcaaattatgtataattttaattaattataatttaaaatgtaaaactgataacaattattggaaaatgtttaggtatattttaaacaatgtttatatgtgattctactttttcagttgcaaagtttataaaatataggcaaagatcaaatacttttgataaaaacactttataaattgacatggcataacagtaaaaagcacaacagattttaaacacatagtataagaaacataatgcaaaatatctcaactacactgattacatattaaaatgatgatttttaaatatattgagctgtttctttttactgcttttagcctggatgctaagatactaagtcacactggtgcattatatttcttttgaacaatactgttctggatggttaatattcagttcttattcctagatttagaaaaaaatcactgaaaactgaagatcatcaaaaatatgccagtccttcataaaaatatcaaaaatttgtggatcaaaaaactctatcaacagagtgaaaaggaaacctgaagtatggggggaaatatttgcaaatcatatgtctagtaaaggattaatatccacaacataaaccacaactcctaagattcaacaataacaaaaaaacccaaacagcccaattcaaaaattaatatgggacttgaatagacatttctccaaaaaagatattcaaattaacaatgactccatgaaaagatgttcaacactactaatcacttgggaaatgcaaatcaaaattacaacgacatatcacctcacacccattaaaatggttactatcaaagtagaaaatttcaagtgtcaacaaggatgtggagaaaccattgtgtactgttggtgggaatgtaaaatggtacagttattgtgggaaacaacattatggttccacaaaaggttgaaaatagaactatcacatgaccttgctatttcacttctggatctatacccaatagaattgaaagtagagtctctaagagatatttgtataccatattcatagtagcattatttacaatagctaaaacatggaagcattccaggtgtccatgggtggatgaatggataagcaaaatgtggtaagttcatgcaatggaatgaaattccataatatgctacaacatggatgaaccctgagaacattatgctaaaagaaataagccagtaccaaaaggtattgtatgattctacttatatgaggtacttaagggtagtcaaaatcatagacccagagagtggaatgttggttttcaggaacacggggtagggaagaatgggaagttactgtttaatgacattagagtttcagttttaagagttgaaaagacttatggagaagtatggtagtgatggttgcacaatactatgaatgtatttaataccactgaactgtacacttaaaaatggttaagatgggccaggcacagtgactcacacctgtaatcccagtactttgggagaacgagatgggcggatcacaaggtcaggagacctagatcatcctggctaacacagtgaaaccctgtctctactaaaaatacaaaaaattagccgggcgtggtggtgggagcctgtagtcccagctactgaggctgaggcaggagaatggtgtgaacccaggaggcggagcttgcagtgagctgagatcacaccactgcactccagcctgaggacagagggagactccctctcaaaaaaaaaaaaaaatggttaagatggtaaattttatattatatgtattttaccacaataaaaacataagccagtctaaaaagtgaagaactaaaaaaatgtcatatattggctgatagaaggaatttagaattcctatgcttgaaaaagtcttatttggcttattataaaatcattgtcttactgtctttgaatatgtaaaatgctgtaatacagaaagacttatatgaaacctggaaagacttatactctgtcatgccaaaaggcaaactaggtcactgggtagaagtcatagaaggaagagcctaacaataacaagttattcaaaatataatataggcagccttaaaagggtgtgaactcccacttcctgggaaaatgaaaggtaaagggcacgtatgcatgtgaagtgaagctgattgatcttcaagggaccatccaaatcaaaggcactacaatcttgtcatttctttccaagtagcatgtattcctgtagactaatagattaacatgaggcaatatttcccagaatgtgttctgaagtacactagttccaagggaccctaatgtgtagtatgaacaggtattctctagtcaaaaagcttgggaaacaccgggtaacacaaaattaaacagtgtttttaaaaatttaattgcagaacttatcagaatcttcagtattttaatacacatggtggtctccaaaataggaatagtcagagttttcaaaatttatttggccatgtaccacattttttacaatctcctgaaattagaaaatgggggaatattctttgaaaatgctaaaacaaattatgcattaattaaatctataaaatttactttgtggaagagttgactggcaaactaaacttaaattcttgactttcttattcacatttgttccctcattcagcaaacattaacaaagcctatattatgttccataaattgtactagaaattcaaagacatttaccttgaagtcactcacagtctggtaagaaagcagacttgtaaaatgatggcggtaacccacgagaggggctgtaatggagctgagcaacgggtgaaggagagtcacaaaggtcctccatattcctgagttctgcatcagtggatttgatcaaaaatccgctgatcagatcaaaaactgcagatcaaaaatatgtggaggaaaaaaaaaaactctacaaagttccaaacagaagtttcacttgattttgattttgccacctgacgagtactatgttgaatccacacaaacgaagtgatgtgttagccatcttattaggtattataagtaatcgacacacgatttaaagtgtacaggagaatgtatgtagattagatgcaaacactacacctttttaatataagacttgagcatctgtggattttggtatctgtaggggtcctagaaccaatgccacatggatgtttaggaatagctgtatatatattatgtatgaagaagaggaactaaatgagtttttttgtggttgttatagcatcgcccttcaaaaatgttaaagtagtcgacagttacttgttaaactctaaaaatctatttgctaccaagtaaagtaaaaatatgtgaatgatccagttaaatatatctctgtatagagtcctaccagatgattcagaccacacaatgataattatccagaagtggttatgaactctggctttggagtcagacaaatatagatttaaatcttggttctgcacattctaactgtgggactgtgaaaaattagttaacttctccaaacctctattttcccaaatgtgaaggggtataacgatcccttcatgttaaggttgttgtaaggataaatgagagtatttataaactatttagcataatgcctggcacatggaatgcactagataatggcaattattattattgctagtttgtttggataattgctagaataattgtacaatctcagttttgtttgttctgtgtggacagagctttgtatgcgatgaaagctgacagatctaaaacagttaacactgaagaatataaagaaagaaggagaaaacttggatagagggtactgggtagtatagcatagtcttaaaaacacagttcggggctgggcatggtgactcatgcccataattgcagcactttgggaggccaaggtaagaggatcgcttgagaccaggagttcaagaccagcctggccaatatagtgagacctcatctctacgaaaaattttttttaaaaaaaactagccaggtgtggtgacatgtgcctgtagtcacagctacttggaaggctgaggtgggaggatcacttgagcccaggagttgaaggttgtagtgagctatgattgtaccactgcactctggcctgggcgacagagtgagaccttgtttctaaaaataaaaaataaaaataaaaacacagttcaatctgaaccttgttaattagctttaggacttggacaatttacctaatgtctacatcagttcccacacctataaaatggaggcaacaggactatctcttagagtagaacccgttgatggcattaaatgaggtaactcattgaaaggtcacagcacagagccagaaatatggtggacactcagcaagtgttagatgctgttattgttaatggaagatttgaggagcaagacaatcacaataataacatgtctagattgaggaaaggaaaaggaaattgtccccatagatcacatgcctgttcatatcatcttttatagatcacacatgaaaatcattccaactcacagcatggactactttgaaatgtaatcaaatattgttatggcattcactgcctggagaccaggcaagtcatgagggagtgacaaaataaggtgaaggaaaggtactctttgggtctgaacgatgtaccactagaagccgtatccccccctgcttgggattaaaatcccttgcagctgcgaatcccaaagagtctaatattttctgagactccactgtgcctttatattttaataccatgacatctggaatcctaaaagtctaatgtttaaccataaatatctgctgaaattaaagagctatataccaagcttcaatctttggggcctgtaattgcttgggaaaagagaatggtattttcccctctagctagaagaaaaagacctctgcaagcacagatattggcagacaaattttctaaccgtttcctctctccattctgtcctctcattttctccctccctctccaatctcccattttataataccatcttgctgtcattctcaggataaatgggaaaaaagagaagcctagaaaccttaaagaaaagacacatttcaaggtctagcaacaaaaagttgagaaactgcaagccactctctgttaagtagctgagcagacgtcaccacaatacctgagctttccccattattcagttagaaaccacttcatcactcagtgggctgacagtcaaatgccagctttattttcttttttttatcaacctaatcttttatttttgatttgaggccagtcacttttaaggtctccacagtggtttataactttctttcttgagaagtgtccaagaagtaacacaatttgaaaaatgttccctactgtctcatggtaaagaatgggaaactcacctgccctgaaggtgtatgtggtcagaaatcttggtcagaccacagtactttgctggaaataatgccaaggaaagtgtgggaaaagcttatcgtgagtttatatttttaatataactattctatgtggcatttaaaacatacacttagtatcaaacccatttttatccactgatatattatgaaagtgacattttgaggtcagtcacctcacttctaggaaaaatgatccatttaaaaagaggtttaatatgttgtttttattcaaataattaagattgtaaatattcctgaatctttttagctaatgttcttttctcttgtggaaatatattcagtgtgttcataagcaagtatgtttatatctgttggtatttggcacagagagctaattcttgattattcatgaaaatttgaaactatccactcactaaattaaaaatattgtcttcttaatatcttgtttatttacttcaaaaggaacatataactctatagtgatgattctcaagcctaacacagcagaatcacttattgtttgtgtgtgtgtgagtgtgtgtgtgtgtgtgtgtgtgtttaactcaaaggtctggactttacacacatctattgattcaaaatctccctacatgccaatgaatgtttaatgtcctagatgatcctaatgataagtcagttttagtagctagtgtcctgaccacatcataaaaaaatattggcaggagaatgaggggggtttgttttgttttaaaattttcagtctattgaagagtaataatttaaaaaaatacaaataatcagacaaattagatatacaaactataagccccacgtttacttattagactcaacagacataaaattactctgccaaattgctgtgtttctaagtggtaaatttctgtgaatacctcactgtagacaggtagccgatagtttgtgggccagcacgcgtggagcagctacctccaagccccacctgctccccttccacctgcacagcttcctggctgcactgcccgcctccagacagctagcgcactccaacacagctagcacaatcttttcagggagcaaggaaaatcctactgccacctttcttaaaatctcccaaaatatatagaaataggaaataaaactgtggttaacagagacaggggtttgggagtgagaggaaatgaggggatgttggtcaaaggacacagagttgcagatatgtaaggatatgtaaggcgaataagtccagaggtgtaattcacaacgtgaggaccctaggttaataatactgtgttgtagtcacgatttttgctaatactatgaattataggtgctcttgtcacaaaaagtaggggtggttaaccatgtgagatgatggatatgttcatttgcttcactatagtagtcattttactatgtgtaagagtatcaaaacatcatgctgtacatctgaaatgtacactaaataaataaattgaaataaaatccaaaccttttactctggccaagaaagaggctggctcctgtctatctgcaactgcttcttctctcaaaaactgcacacagtggtctcctttccacccacctctcacacatgctgaggcccttttggatctcagagtccctgccctggctgctccctctgcctggaagtctcctccctctgctcagggcaggcactcctcactccccattcaggtctcatttgaaatgcaactatttcaaatagcaattcgcctgcacacaagacacacacacacacagacaactcaaactacctttctagcccaaaacactattgtattttttccatccttctcatctctcctggaatgtgtgtgtgtgtgtgtatgtactttatatatatatattttttattttatatatacgtattttatatattttttatatattttaatatgtattttatatatatttatatatttttttacatatatataaaatacatacatacacacatataaaatatactcatgttatatacatacacatacacatatatatgtgtgcatgtgtatgtacatgtattatatatataatatatataattgttttagagacaggtctcactctgtcaaccaggctggagtgcagtggcgtcatcttggctcactgtaacccccgcctcccgggttcaagcgattttcatccctcagcctcctgagtagctgggatcacaggcatgtgccatcatacctggctaatttttctatttttagtagagacggattttcatcacattggccatgctggtctccaactcccaactttgggtgatctgcctgcctcagcctcccaaagtgctaggattataggcatgagccacagatcccagaatattttttatttggaattttgtttatgtacctctggaatttttatttgtttatgtacctaaccctactggaacataagtttgatggcagcagaaatgttgttttgctcattgctatagtttccatgcttagagacgctctggtagacagaaagtaggcaaaatacacttgccaaatgaatgaaaatgccaatttcagcgtgtagcataaaaaaggtgctcatgcaatgctagttttcattttacctcccttccacttttttttttgtcatggctgagaaattgttaaattctgttgaaactgaagctctgatttctttctgctgcctcctgacactgctggtgccccacatgtgtgaaccggggtgtgaggttatgccatccatttgtagtctgggacagacggaaactgagtttggagccagaatggaaagctttggtatctgcctaattctacctgaatgggacattaatttcaatgctttgttcttctaaatgattttgaatgttcagatcatcagatgcctccataatcaaaagaaatcctttcgagaataaaatgtaaatggttctcagaagatcacctgcttggcatgagctgtcttgctctctactgttatacatttttccaagttggctgcacatgcaaacttacagataagtataaatcaaaattagcagctctcttctcccctggctacacatcctgcattacacagatagcaaaacccactggcagagtgttcctcagagctgatccacatggatggtttttgctcctaatatgacaatatgctgggacctgtggatatctgtctgggtgagtagtttttgtacgaacttatatgtgcaaataaaatctgttattttccaaattaaaaataaacctcaaaggcaatggattccaaatgacttggagagatatgtttaaaaaaatatggaaaggatataagggtctgttaaactcaatgacatttggaataaatataaaattccagtggtctccatcttcaccttagctgcattgctttctctgatttactgaagatgataatagattcttgtcttgaactgaaaaaatacaaaatagtcattaattatcctaagattaaatctgtgcttttttcatccaacagactgtggacagtaactgcaaagtagctaagagaaaatggtttaataatgaaaagaaatttgcattaaggaagaagggatttactcatactttggaagtcaaagaaaaatactgcaatcctgtcagcacccggaaggcaccatttactatgtgctgtctctttcattgcaagaggacacagattgtatttttagtgcagtaaacagcagattccactgtgggaatccttgcagttggtacctatagcaacctcatttaaaatgttataaagctctaaaacatcaggggtttaggcaatcagtcatatatacctccatacagacattcagccactcacacacatacatgcttgtccacacactgatagtaaatcgtgtgtaatatgatattactcatggagttttaccattgaatcatgtttgacagccatggtaaagaactgagaaaaagcaaatattctaccattgcaaccagcagcaagaacatatttgtgcctaaatagcatattacaccatctggtaagcaaccacctaaaatgaacactcttatgattaaacatggagaatctgactgacattttagagtttctatttgtaagggatgcttttgatgccacacccatgtatttttggcactcaccttcatacaccaaaggctgctaccacaaaacctatgacttccttctgaaaaagctttttttcttttgataattttggtatcaatgtttttctcttttttttttccttctgagagtttttggtggcctcaaggaagagcacagttagcctgtgttcagagaaagccaaagggctggagagttaatgtccccaaagcatcccccaaagtcctgacagaaaagaaaggtaagctccaagacaggggagccaggatttgaaatattaacacatgagcttccctgtggcttggctgggataatttggggtgctgttcccatggtctcccgcagttccctatcagacttgagcgccagcttccacagtggtaaccagtttgataacacttcccttattggccttatttcttttcctaggatacttcctcattttcctactggtgttttataggatcgccccccattaaactacttggattctaagccttgtatcagggtctgcttctgggacaacccaaactaagacactatcttcagtctttattcccttctgttaggataaaatataattttcatcaaatactctggaacatacatcccttatggattccaaagaaatgggatcctcaccaaaagctcaagtccagaaaagtcccacaattaggcatgtgcttattttaacatatcagaatgttttccccatagcataaatacctgtaatggtggaataattcttaaaaccaatagaaaacttactatagaacaccatttgagtagatctaggggtaaataggagggtaaccccttatcttttcttcttttgctactttctttttagtgctacccacatattttctcagtataaatgtgtccctgaatttcattcttctgtgcaaaaaatatatttgctggttctattcaacaaatgcaaccaacacattaaaacgaacatttattcagcatttccatgcgcttggcactgactttaaaaccaatactgtagtccttacagcttttcactctattccagagataagccttcaacatatggaaaaacataaaataaatgttaaaaagtataaatattcaagcatgaaattttatggtaattaaaagaatcatatgtagaaacagctccaaatgtcaaatgctgtactgtagcagtagttcaggtgaaagaaaggtgaaaacaagtaaaaagatacatagaactgtctgcattttaggctttcatattacagataaattcttaaaccaatgacctgaaggcctcagttcattctgcatgctcttggatgacgtgtaacagcaaactcttctggctggttacttataatccattcatttgatcagtcaaccaaaatttattgagtaacccccaaatacacatcagtgaacaacaaaaaaaaaatcctgccctcatgaagtttgtgttctaaaaaggataaacagtacattaacataagcaattacatttataatataatgttaagtaccacgactctaacaaacaataaagcaagcacagtagagctacagaaaaatgatctcatgattattttagatagggtggtcaaggatggcttctctgagggtaccttatttgaacagcgggaactagctcccaaagaagtgagaataaaatattccaggaagaggaaaaagccagcacaaacgccctgatgtagtgatacacataccatgttaaacgaaaaataagagaccaggataagtaagtaaaaggcgtgtcacaagagaggaggtgagagagtgggcaggaaccaggggctacaagacttacaggcttgtagctgggacttcattctgaatgggtggaaagctgaaaatatccctctggccatgtgtgaagaatagactagagactacaaaagtagaagaaagaagaccagcaaggaggctattccctcatctagtgagagacaatggtggctagtagtaaagggaatggtgagggtggtagtagtggaggaaatgagaagtttgagaatttgggttaggaaaaagaaaaataaaagatgactcccaggttttttacttaaatagcctaatgaatggtggcaccaattactgaggtagggacagctaggcaagaagcaggttgtagattggggaagagatcaagaatctttttgaggcatattgagtctgagatgtctactatctttccaagtaaagtcagttggctatactagaccaaatttcagggtcgagtctaggctgaggatataaattggaagtcatcagcatttgatggtatttcagtcttggtcctggggagcaaaattagagaaagaaggaaaaaggtctcaggacatagtcctgtgaaagtcacacattcaaaaatttaaaaggacaagggagaccagaaaagaaatctaaaaagaatcaactaatgagatagggagaaaacagaaaaacttctttacatttgaccggagcaggttccagctgaacacaaatgagaattcagagtcagcttgttagtggaaataaaaagacaatgatctctccaggggtccagccataaaaattgacataaaagggtgctttgtttgcataagcaagaagaggaagaagtttggagcacagccttgtttgggggagagttggagaatggagaaaagggagacaaaacacatgacatctaccctaccattgagagagcgctttaagtcctgacagaaaagaaaggtaagcttaaagaaaaaggagctggttccatggcagaccagtatgaaacactgagcatgatggctgcttcaggcccaagtgcccaagctgggcgagaactgtcctcccagctgtgcactaagttgggcattgagaatctgcacttttgacatggacacaggcaatctcatagagggcacagcagtaaagttgtgagatcacataatgactcagcattcctgtaatacaggtgaattggcagcagattagcacagactccaactctagaatttaggtcttcaccagtacatttcattctcagtgagcacagcaaaaccagctccttcacaagcacccttgcctctaccacaggcattgcattcagatatagcttacctgcgttgaagaaggatgcagtccattctgcctctgttttaggaaatacagaaactggtggaggcagacccagggctctcccatccagatccttgaagagatattttcttggacttgcacagtctaattcaggacagactacttttcctaaatctttcctgtgaagacagtcaaaaagcaactctttcatttcatgataagcagcaagaagaaaatatacattggtagtgctaatgttgtttaaaataaattcaacagatttttattattgacaatgtgttacatagatataaaataaaactctttatgaaataatttatttcccaattatatggtcaagaagaaagacattcttactaaccaaatattttggatatcctaatatgtaatctttatatagattgctgattttttaagaagcaagatacaataaagtgttcctctcataacaactgaacataatataattatttttaggaatttcaggggtttgcagtattttagaattattataaatatcaattatatttatgctatatgcaaagaaaaatagatattctcattcaacaaatatctattgaaaacctacaaaagacaggctgggtaacatgatggtaataaagccaaacatggcactgcactttcagaatttagagtcaagtgggctatataaacaattaatagataattataatgttgacttacagagaacttattttatttcccctaatctaatgctttgaaataccattagtaataatattaaatatttattgtataccaacaatgtattgagtattatcagcacaaagattcagctgttaatatcacatagtactatgatttgaatgatggtcctttcaaatttcatgttgaaacttaatccttaatgaaacagtattaagaagtgtggcctttgggaagtgataaagctatgaggattcaattctcatgaataagatagtacccttataaaagggcttgaggatgaagagagtactctcttgcccttccatttcttctcctatgtgagaacacagcgtttctcccctctggaagatgcacgaacaaggcaccatcttggaaggagggagaaaccttcaccagacgcctattatgccagtgtttgatcttggactccccagcctccagaactataagaaataaatttatgtccaggtgcagtggttcagcctgtaatcccaaaactttgggaggctgaggcgggaggatcacttgagctcaggaggtcaaggctgcagttagccatgattgtgccactgcacttcaacctgggtgacacagtgagaccccatctccaaaaataaaataaataaatttctgttcttcataaattatccagtctgtggtactttgttatagcagcacaaacagactaagacatgtaacttaacagctatatcagcccgggataagacatgaacataaggaaaattggatagtaaattttaaaaagtgacaaaacaacacaaattgcctacctactcatgtttaggtacctaatcatgattcagggataggcatcaaaaagagactcgtgttaagccaaacacatgaatgttctaattagggtggcttctttagttttttgctttgtttttttttcttccaataaaggagtttgccccagtgttgtgggaaagaaaaagtaattcattcttcctgtttctaactttctactctctttcatggcataaaaaaatcctatctaattttcacatatttgaatgaaactcttagatcatatgtcagaaaacagtatttacacctggtctgaaataccaatatctgctagacctcatcgttcagttcagagattcctgtcagcagacacaatctccttctatctactagttcctgcacaaaaggctcccaaggtctccttctgaagaccactgacactttactccaatgaagaatgaagaattagagtcaatttattaccagcaagtttgaaaacatcccaaagaagtctctctaattaagacaaaacaataaaacaatatcaataaaacttgcacttcattacttctgcctctttcatcagctaaagaaaatcacatggctgagtccagattcaagggggagggaaatagcccctgcctctttagtgagagatattttaaaaatcatatatcacaaggcgtgaatataggaggggtaaagaattggtcattaagttaatgtaccttaccattctaagattcatttctatttctttgatgattttattcctttcaaaaaacatgtttagggtttgaagaattgccaagtacttcataaatatggcttattataaatactaaaaattatacctgggttgtaatgaaggaaagtagaacttgtttttatcttttatctttagcatcctggtcctctctgctgttattgggtgcataattccactgttctctgcatttggtagaatgcagacatccaggtcatcgctatagcaactcttcacaaaactagaaaaggtaacatctgaaattttaaaaatatgtatcataatattatatcatataaaccaccagccacaaatatcgaatatacaactaaatattgttataataatgtataccctaagttagttaaagctatccaggatagccttaggagtttacatacatcttgatataaaatatcagtagttcttcaatacatggacattgcatgcaacagagaagagtatttcaatacgttaaacctttaagagcaatatggcttttcatttgaggcttaatcaaaatccattcattttacagaaagacaaacccactgccagataaactaagtaacaggggagagactacaatggtggtacaagagatctaatagaagatgaactgcaccagtcgtgtcacaactttgattttaaccctcgttgctcaaccatctactaagcaacttcagatgagacacaacttctacatttcaatttcctcacttgtataataggaaaaataacacctaaccaagagagttcttatgtaatcaagttaaataattgctgtgttagccgggagtggtggcttatgcctgtaatcccaacactttgggaggctgagatgggaggactgcttgaggccaggagtttgagaccagcctggtcaagatagcaagatcccatctcattatattcaaattttttaaattttattaaaaaataatagttgttgtagaaagctcttcaatatgtataaagcagtgacttttgtaagaaattataaactaccattgtggctatcaatactcagcaggttggacagcaagcactagaccacaatgtacctttttgttgataaaatttcagaatgccattaaaaattttatgcatggatgtatgaaatggcactgcctagataaaataaaacatcctaccttgaagtttcatgattcctgaaattgaatgatcattcctcactttgtgccatggctcctgaggccactgatttggttctgaggtgaatacaggccacagaataccaattcgacctcctcttggattggagggagctctatctgttgatgtcaagttggctgagtgcggcttcactttgtcctgaatgcagtcaaaagaagagctggtggccacaatgactgaattcctaagcacaatctgcacttttttgacggaattttgtggagcagaaaatacatacactactgccaaaagaccaatagtattgtctaccagagtaatgttctctatctccacgctgttctctacatgtaacatggcaccatagtcaaagttcttgaaagccaagaagccagagattctggtacagttgtcaagtccactttccttatagagatgaaggccatgaagacttgaatgcgccacattgtcagaccaaagcagttcacaagaggagcacttgtggcctcggatgtgaaagccaagtctctctgatcctgccacaacgttgccatggaggttgatgtcctttacctggttcactttgattcccgccacccaaatggtggaccacgctggctgtgtcatcagaaccacaaggttattagtgacagtataggcctgaccctctaaatctatgccatggccagctgtgccaaacacaatattgtcatttaaaagtactccatgactggcagctgcatgaatgcccccgccacagctctggtgcagagtagatgatatgatccaggatcctgctgacacattactgaattcaacagatgagtacaatggtgacccgaagttctgaatttccacattaagaagttgaaggacacctataaacaaatgcatgtcatcaggtactttcctcttccccacaaaaggctgaagaatggcccattttggggcattaagatatgaacatttttaatgaaaatgtaagtttattctcaacaccaacattatatttcacaccatagattctcaactaaaaatgtaggaatcattacaagtatcacattaatgcctgaattgcatgtgcagtctgaagagtctggtgacaggacagggaaagatgagaggagaaataggaaagaggcaaactttggggatgggcatggccaagtttaacgattctgtgtatttgtcgggggccgggtcaaagaactgggtaagaatagattctgggtttctggcccttcacctcaaagtcaagtctccctctcagtgtctcagtgacaccacgtgaaaggccacagccattcccaagaagacactgcacaaatgaatattaagcatttctgaagaagagtatgagtgcgaaatttccttctgctcagttgatgtccagaagcctgatattccatacatgcttctgattaaaacatggtaggagcaataacatgcttttaaaatcactttaaagattctgtaaaatgttttctatatttttatcctgactacactttattcactgtttcatttttataagattttctatatcttttatgtgaggagaaaatagtgaattatttactctcatttgtagttttatttgtactgttttaaatagatattgttaaaacacactataaaatacacccagtaagttgatttaaaaatacaatgattcagcatacatacttttggtaaaattaataataacatgattatagatgaattaatatgcaataataatgaggtgaattaaatactttaactctcacataacactcattatttgcagacaccgttctaattcttattcatttatttattcatactcctaattttcaaaaaaatcctatgaggtaggtacaattattatccccattttacagataaggaaattgaggcagagaagagtgaactaacaaactaggacttaaacttaggcatatggatgagaagccgcactattaaccccatgcaggcatcctggaaagacagaaagactttgtggtacaaaagtagcatctctgcattatgattcagataactgccctatagctatgagccaataattagttgtgtgtcctttgctaggtaggtcacaactttggctccttttatttcatttttaaggtactgactaaagtaaactataaagttatttatctcattaaaaataaaggaagcaatacatttgaagtttctgtttcactgtttcaataatagtattaatagtatttaagtttcaaaggcagtacagcctaaacccctcatttctccactaccttttcagaaatgagaaactagaacccttgcaaatcggctgccatgaagaagcaagtccttttgagaaagacaggctaagtaaaggaacctatacgtctacttggggccaggcaacaggattccgaagtatctaaatttctcaatgggtgctattgaggaggcattcgtagatggtgtggacatattcacagaacaataaaacatccaaaagctatttcttgggcaatatccctcaccaatagcacatagctgaaagagctggcaaacctgcttcgtagaactttggcacaaagaacaccaaatgcaagcataagtccataaataaatagcttatttttagcatttaatgtgattttagaatctctgtcaaggcaacatgtcagtattattgttatttcctaggtttcttataaatgatattacaagggagataaataaagagatgtgtagggcacggcatgagggaagggcatgcagctcccattccctccccgggtgcgccaccttagtctaggaagctccacatgttcggctatccagaagctctcaggattattttaattatcagtttttttaatgtcttatgcttccatggatttgattcatagttttaaactgtacaaggtctttttactgctgtgcacattaaccaatgactgaaaattaatcaattagtaaagacttaaaatgtcttgagcattaaataaagaattaagcaattttttttgagatggagtttcactctgttacccacactggaatgcagtggcatgatctcagctcactgcaacctccatctccagggtgcaagtgatcctaccacctcagcctcccaagtagctgggactacaggtgcatgccaccatgcttggctaatttttatatttttagtagaggcagggtttcaccatgttggccaagctggtatcgaactcctgacctcaagtgacctgcccacttcagcctcccaaagtgctaggattaaaggcatgagccacagtgcccagcctgaatgaagcaattattttattcacaactattttcctatttttccttttgaaaatcactactgaaaaatatttcagcaagttaagtacaacttgctgggtattattcaggaagagaagaatgatggagccctccaatataaaagtaggactcaaaagtcttggcctgcttttctggtctataacaaatcagtacccatatctgccatccctgacctacacctgcagatcccttcttattcaggccctggactatgttatagaaaaatgtaagcattcttaatgcagggtataaacctgaattgaattctggaacagaaaaaaactgataaaatttgaagaaagtcttgagtttagttcatggtcatgtaccaatgttaatgtctttgttttgacaaatatactagtattatatcagctattaatggaagaaaattgagtgaaaggtatacaggatctctctatactacctttgcagcttttctataaatccaaaattattacaaaattaaaagtttaattaacaagaaccaggctcgaatctaccacttactacttgaatgactttccttactcttcattaatatttttcattcatatttattaagtacctaatgtacagcagttaccacactaggaaaacagatgaaagacctatttttcacctcaaggagtttataagctaatgaaggagctacataaataaataggcaattgtactatagactctatttcctgtaataggaatataaatttctcttatgaggattttaggattaaataagataaaattttcactgtatgaaaaccagcacagtttctggtccacaagaaacacaaaatagagtttctgtttcccttccccaggggatgatttaaggatcagcattgttagaagtttaggatcaggtcagtcttgctgctggttctgctctggcttggtgctcagctgtaagaactggccttctgtcctgttcctgtgaccatgctccagcttgccctgtggcttcagttaactgggggcttatcttgctctctccttcctgattccccatcttcctcaaccttagaatggggttcttaaaagaatggttcaattcttaaaagatttgaaccagcctttgtctccatcatctagagcagggttctcaacctcaacactattgacatttggagccagatactcctttcctatgggtggtcgtcctgtgcatgcaagatgtttggcactacccatacatgccagaagctccctcaagttgtgacaagtaaaaatgtctctagatattgccaaatatcacctggggtagcgggcagaaatcaccactgataacggcttatggagacagagcttgctctattaactagaaatcttaaatgtctgatttaaggtccaaacactgccctttacaaaactggtaaaatagttgtgccaacaaagagtgtcccatactgaatatatttgggaagtgtttagatcctttattctcggccttctccaggcctttatatattcatgtacaccacgattttataagttggagctacagtgacaaccaaactatttgatcaggaaagaactttggaataatgtataaggaacacaagtttaagaaacgaggtcctaatcaaataattttgcagcattccaaaagggctaaaacttgaaagaaacaagaaagattgaactgatccttaaagcagtctgaaatatggaaatcatttttatttaaatttacgctattaatttatagcatgaactgatgcctgccatcagatatagcatgctactgggaaagagtaacagaaattcaggaaagagataaaattgaagtggtcattaaatcatctataatttcaaagcagtggaaatttcacatctgctgaagatgttttctttgaggtaaaatgtgcatatgtgctgaccactagtatattattttaacatcacactgataattaagcacagattaggactgaaaattcatagcttctccaagcacaaaggaactatctcatttgaacattttgttttataaatgaaaattctcacagttgggatttctgggtgtcccagatgaataggctccaactggtaatggccaattacttaaaatttcatttacctgaaaattcttctcggctggacttcctgaaggaccccacaaacagtctccccctacatgatacgtcaggctgaatttgtatatttcgggtcaacagtccaacctcagcagccaaacgaatgtgtcggccatcctccgtgacatgtacacttcctggggcaataggagttgtgggaaaaaaaaactttaaaaacctgtttcaaaaatcactagctggggacccagcaaacctgagaaatgaaaacatcctttcccctcagaagttctaccaacattaaggtctgcttttcctggggcattctccacaaaggtcagctgagaaataaaataacccattcacttgtctctctttgggatcagagtcagagtgtttgagcaagaattcatttcttcttaataactgtgggtactggaacaggtcactggttcagggaagtcagggcagacctgtccaattagtggggtccccaacctgccttaaataggtcagcgtgagacttcagtgttgggttgtacattgtccgtggacctctttcatgagagtgaggagtcccacatcaactgaggcagtgacagagcaaaagcagctgtgtgtaaaaggaaagcgagaagcagcaccaggcagcagcagcgccctctcatggtggatcttccactcatcacggcctgaacagcttccacagcagtgggaactaagcgtcttgctagtttgtttcactgtctaccatttgcatttcaccttgcattttactgaaatcattgctgaagatttcttttttctttgccacttactaaaaaagaaatgctcctgggaacattgatttagacagagctttagatattcctggtgaaaccatggatttgcctctcaagtatcagagacaaaaagacattctccatcccctttatttccacagtttattactgattagctatatctcctggattagatttatttattagactgaatcaggaaggttattgtgatttattatttatatgtagtacattctaactgtgtattgtgtataaaaatatttggtaccttttttatttaaaaaaaggtctgggcttttttctttcattttttgcagtaatagtaatagtagtagttaatacataaaatgtacttcatgtcaggaaggacacatttctaagtatggaaaatgaaatcattatttacagtaactacaatattctaagggattataattcaatgtgtcaggaaataaactggaaactcagtgcccataagttttattctggcttagccagaaaactgcccagtgaccttgaacaagactctcaacccttctgctcttagatttgccattataaataaaaagcaaaatgtgtgtgcatgtgtatgtgtgtatgtgtataacatccaagtattctttaaaaataaagcaacaaaattaatgagggaatagagataaggccacgtagcatgagtctaggtcaacaggaaggcattgttcttcccctctgaatggcaatcagatccgaggtccccagctaggttaccaaacatggtcttcctagctcattcacttaccttaaccaacaaaccaaagccttaccaatatgccggtgtttgagccgttcatagatcctcacatggtggcccttgacttctttcacagtgaggacctctgcttcatgaggctcataagaagaggagctaaggactattttgtcatgggggcgccaatccactgcatcttctactataattctgtaacagcataacaatggcattggatatactaacagtgcagcacaaatcatctattaactccagagcaagaaaaggaaatccactgtgaccaacatatcccaccagagaaactgaaatagaaataagacatggcagtggaaaaaggctttcgcaaacagtttaatttagctaatggagtcagttttctggcttgaaaatgtatatgttacagagacagtgaagatattcgatgacccctgaaatacagcaaaggaataaaaaacaataaaagttccagaggttagtacacatgtctacatcagcaaccttctttctggattagggaacagattcaataataacagcatttcagaaaagaacttttctctaattttctagagaaatataatgccattttttgacaactttggacattttggacaacttttcatcatgtgttacaaatcctaccttcatgatgaaacagatacaagtgtgaatcgtagaggtgtcacttaccagctgtgtgaccttgagaagtcacttcactcctcggcttcatatcctcatctgaaaaggctatatttgtactttctgtcttctctttcatcacattatgaaacaatgagggttgtgttcatttttggtatttttcaagacacacatttaatacagtttctgttcagtctttcactgccgcctagcattccctctgaatatgactgttttattttcttcatagtcattaccaacttcaacaccataaatttaattgcctgcttcattagctaatgcccaaagtttagcaagctttgataaagagtctcctctatagtgaatgttcattcagacaacagtgtccatgtgcagggcattcaatcatgcaacctttattgaccgagcaaatcttatgcaccagacaatagagtagatgctagagacatacgataaataaaacatatgtcatttgtattaaaatacataacttaaattctgcctagcacatatctttaaagagtctactgtatgggtgtgtattacacagtattctgtgtaataccatgggagtacatattaataatacagatgtttaatatatagtattaagcccctaaaaggaaacataaattaaacctaatcatttgcaagccaatggcatgagtctaataaatgaaatattataattaattcacatctacgtacctaaggttggagaaagagtcatagagaagacaaaaaaactactatcaattgatgcaactttaatgaaggaatttagagtcttagctctgttcctgatttgctatgacttcctagaaaactcccagttacagaatatttaagcaccacaagctttgaaaggcaaggaaactaagttccaaatagatttaaataacaaaatgtaagactagataaatacatggagccagtgattgaattaggacaaaggaagactactgataaagtccagcattttttccactaaataatctcactttgcctgtcttatttttagttcttcaggtgctaaatggtattagaaaaagagtattcccacttttcataatctatgaaattataagaagtctatgatccatacaatggaatactgtatagccatttttaaagtattttgttgaagagcactgaattacaagaaattttgttcatgatgtattgatttcaaaaagcaggacgtaaaataatatgctccattttttaataaaatgatacatgcacagaaaataggaaagatgcatgttaaaatgttagcctacctatggatggtgggattattagtgattttcacttaaatctcaattttctaacttatcaggtagtatattgtagttagggaaaaaaaagtcaatctgctgtataattgaaattaatcctttacttcatagttagtatttctcagtagtccccaagctttttggcaccagggaccagttttgtgaagacaatttttccacaggggaggtggattcgggatgaaactgttctacctcagatcatcaagcattagattctcataaggagcatgcaacctagatccctcacatacacagttcacaatagagtttgcatttttatgagaatctaatgacccctaatcagacaggaggtggagcccaggcagtaatgctcccttgcccaccactcacttcctgctgtgcgtcctggttcccgataggctaaggatctgtactggtctgtggccctgggggttggggacccctgacctagacaatctttttattattatttatattgttgaataaagctcttcaaataataggtcactataatattctgagaagtttcatgtgaaagtgagattaaaactcatccacatgagattttttagggcaatattctgtgtaatactatgggagtacatatacacgatcacacatttgtaaaaatccatagaactgtttaacattgagtgaacactaatgcaaatttaaaactcataaagcttcattttctaacttccttatataagccatctgctccagccagatgaatcagttcactctcccctactttgctcttcaggtctctcattcttgaaaactgacacaagtcactacggtcactatgccttcaagaagtcttcaatgggagtctctttccactgaatgcccaaagcctccccactttctgtaccaccatcaatttgacataaaaaatgctgtttattgccttgtgactggttttgtattcttgtcttctgtgaccattcaacttttttattgttcattgatatttaataaaaataagactatataaggccaggtacagtgcctcttgccttataatcccagtactttgggaagccaagacaggaagatcacttgaacccaggagttcaagaccagtctgggcaactagagtgatcccatctctacaaaagtgaaaagaaaaaaaaaatgtagcctagcatgatgtcacacacctgtggtcccagctacttgggaggctgaggtgggaggatggcttaggcccctgaggttgaaattggagtgagctatgatcatgccactgtactccagcagcctgggcaacagaatgagaccctgccaaaagagagagagagagagagagagagagagagagagagagaaaacaaagcaaacaggaaaaaaatcactatctaaaccccatagcacctaacaatgttctaggaattattaaaattattagttcaaactttatattaaaaacataaataaacttaatctgaccttttctgttctggcttcccaaaccttatgagttcattaaaatgtatctttcctctatactcctgaagtctttcgggttctatacatcatgagaaccatacacagatgtcaaaggagcattgccccttccacgtctatgtccatatagcaacagtggtaacttcagaggaaactggggtctcagtatcaatagcctagttggttctgctagtcaaatgtcagttttccttaaattccaacatccactattcctagttccagtcttcaaacattatggttacccttcaatcatacgaactagcttaacgactggctcaaaatcccagctgtattctctgtattttattcctctgattagtatgactcctagatcttcagggaagaggggagacttgcttgttgttatgagcaaaacatacctcaaataataaataaacaaaaaattaaaagactttttttcaacataattgtacctaaatggaaaccatatgagaagagagaggaaattatgaataatcactgtggaagtctttttaaagataactctaagaaaatataaacaaaatatcagtacagtttctttattttggcataacttttgacctagttcagagaaaaataatatttactagacaaaaatataatacttattatttacagagaatttaaaaatgcttcaaaatttgatttaaaagtttttacaaaaatgtgtaagacattcacgtgtaaacacctacaacttaaatgaatttgttaacttaatacttgtaagatcttaatgataataactgcatttgaccacaggctcagagtgtacatatcacaaaacatgccctgtctcacctgcacctccaggaatagggatggccacagatttctgaactctactaatatttagtctttttcattttgtaacttcagtttaaaatttttctatcagtgccattaaaatgtaatgaggattctcagactgtattattctacacttgatagagaagaaattgaattctataatgatgctggtaaagatggtgagtgacaacaattatagctatagtcaataccaattatttgtctacctgacttcctctctgcttcattccaggaaatccctcacacctcatctgagaactgctcccatccactatactgaaatctgtgagagctgcaggttaaagtcccacaaacccttcaccaaaggctgggcataggatccaacctgcattcattcaccaaaatctttcccctggaattttgaatgaaactgaggggaattagtagtaacctcctcactggtggtatagctaggaaaagccaaacagatctgagttcacttgcaccatacagaatgaagaaaactattctccagtagaaaaaaaagaggttgaaataaagaagtaaaaaagtagaggaggagaggaagggcttgatacagtcttcaaaatggcttaagaagggttacttttacttgtactttcgacttaaagagccccgattgccacaatagctgccctgtcttaaggcttacactgtgccagaaactgggcttaacacctcatgtgcattaactccctcaatccttataactattctattagcaatgtattgttactcacataattaaagaaaataaaactgaggctcagagagagtaatttactcagagttacacctttagctaaccacctaactagaattagtctgcctgccctcaaagttcaaactccttttcattgcagaatatatttccaacctaccttccaaacatatgcctttcaccagcatcataatagtagtgaatttggcaatagaacccaatagtttattggacctctaacatatgaaaaaaaatcatcatcttttagaggttacatatgtgatcctgaactcttgccaatgagtgcataaggccaccaactctatattctaatacttaaactaagttgttataataataaagtttgaggaatgagcaaaataaattatagtagtatttgaaattaaattcaagattctctcatttgttagataatatgccattgaaccaagaagctcaataagttctgatttctagaaaatacacatcaagtcaatgtagcatgcatttattggagcccttctttatgttctgctgtgcactagacactaatataccaaatcaacaataacaaaaatatatctctcccctatagaagccacttggaggaacaggacacacaaatgttaaacatcttagtgttatgcttttcttaaaattacaaatcataaaatcacatcttacgttcagatgatgggaaaatttgtagagtcggagatacctaaagtcctgtgtctgatgtaatggaatctttaaggataaataggaagttatacagtcaaggaggagatgcaagaatactgcatctgatactcttatttcatttattaggtacttaaggagccagtacaaaagttgttgtagagagccatgggtgaagtgctgcaatgagaatgtagcagataggaaagaaaaaagaaacattccaaacaaaatatatacaaagaacacatcattaatttaacataggagataaaggaatagatataatcaattatgacattcaatttaaaggtttagggcctggagaaaaggatgaggtaacaaatgacttgatttcttattcagttcacagtttcttccttgtaaataacagagtatgttaataaatcacttcagacacctcatacctgtcaaaattaccaaaacagtgaaagataacaaaggttagtgaggatggaaagagaagagaacccttgcatactgttagtagaaatgtaaattagtacaaccgttatagaaaagagtttggagggtcctcaataattaaaaatagaatatgatccagcaatccatcttctagatatatattccaaggatatgaaatcagtatgtctgagatatttgcactcccatgttcacagcaacattattcgcaagagccaaaatatagagtcaatctaggtgcccatcgacaaatgaatggataaagaaaatgcagtatacacatacactctggaatactattcagcctttaaaaagaagaaaatctggtcattagcatcaacatagatgaacctggaagacactacgttaagtgaaatgatccaggcccaagaagacaaataccacatgatctcacttgcatgcagaatcaaaaagagtggaattcactggactagagagtagaatgcaggttaccagaggctgctggtttggctggtggtggggggaagcaaaggttgaagaaatgttgataaaagaatacaaaatctcagttagataggaagaataaattcaagagatctattgtgcaacatagtgactacagttattaatatattgtattctttaaaaatgctgagtgtggatgtgaagtatccttaccacaaaaaaagataactatatgagataatacatatgttaattatgtagatttagccaatccacaatgcaatacatgcatcaaaacatcatgttgtacagcataaatacataaaatttttacttgtcaattaaaaaataaaacgaaataagtcaatcacttgagaaagaaaggataacaggacaaagagactggatgtcttatatattttcttgaaaattcaatgagataagaaatgagaaaaaaataagaatttgggggaagtttcctcataatccagctcttctccctgttttccccttctcagtaaatggcagcgctccttacctagtttcttaggtcaaaaatttaagagtgatctttgactcttctctttctcttttcctcaatattcagtccatcaggagtcatgtcacttctgtcttcaacatatatttatccacatctttactcctccatcactgccatcctaatctaagccatcatcatgtgttacccaaaaaactgccatagcaatgtcttaacagttagtgtctctatttccactcttatctcttcctcatcaccaccaccaatagtcaattctccacacatcataaatcagattaaaatataagtcaggctctgtccatgtctcgtttaaaatcttccaatggccaagataaaacctaatctttatcataagattggttgacaaagtaaccatttaatttcaaagatcacatggctacccttcaaagactcacagcaaaagatatacataacatttgtaatgggtaaaagcaattttttgtgtctaaatctaacttgtcttgatttatttacaatccaaataaaacctcaacagttttgttcatcagtcttcacaagtcaactcaagcaagcaacaacagagagtaatttagagataaattgataaaacacagaataaaagaaaataatttttcttcaaaatatcttgctaagcttactttggttgattgtgtaagatacaagcttataaagttaacatgaaacttttcctccgaagttttcacactaccattattcacatatatatatatatatattttcaggtatcaaattcttttggtgaaaattcatgaaacagttcatctgaaatatgcttatatcacaatatattagaaagacaaagacttattgaattgacttttaagattgtagagccatgtttaaaaaggtggcctaaataaggtctgtagctcagttaataccgtaccaatatcaacttgccagatttgctaatgttctatagttatgtaatatgctatcatcagggaacactgagtgaagggtatatgtaaactactatttttgcaacttattttgagtctgaagttatttttaacattttaaaaaaggttttaaagagaaagaattccataaaatgaatatactacattaattgcacatcatttgtataaactcattaaattatttctcctcaggactgatactaagaaactttgtttttaatatttgtaatatgtagaacacacgcaatggaatcagacaaatcagggtgaaaaatccagcctcaggaatttctagctttatgaacttggaacatttacttaacttctccagcctcagttttcatatccataaaatgcagataataatacctaacttatagcattgaaagatttaaatgagataatgtatgtaaaatgcttagtagaggcctgacatataacaagcttacatgataagaaccaaataaatggtagctagttaatgactatggatagttttaattaataaaattgagttcctttcaaaatagcctgtagctcagactccaaatgaggtttttaacacattcttataagaaaaatccattcatatggttcctgccaaattccagcttgctaaccttttaattataattaaagtttcttattgatccttgttagaaatgcttacttcacaaatccttttgaatatcagaaaagcactttaaattcaacatgacctaatctgaattcataatcttttctctaaacttagtcctcctcaagtgaatgacaccactatccagctacacaaaccagaaaccaagaatgcacttcatattcaatgtgtcttatagggtttatctcctgcctttaaatctgcccacttctccattgctcctgcagcccctgactacaattacactgtctcttgctgggtgtctctggatctactatcaagctctcctgctgtctacattctgcctacaatattttagatgtacaagtatgataataagtgttacctcctatccatactacccccttaaaaacctacaacagcttcacaatgctcttagggtaaaaactaaaattcttttttttttttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccccttcctgtgtccacgtgtactcatctgacagagggctaatatccagaatctacaataaactcaaacaaatttacaagaaaaaaataaacaacccaatcaaaaagtgggcgaaagacatgaacagacacttctcaaaagaagacatttatgcagccaaaaaacacatgaaaaaatgctcatcatcaccagccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaaaattcttgatattgccaatgtatgtggccctgacacttaaccaactccttggaaccctgtcatgatcagcccctactctccacatcaaccatcatggtattctttcagaccctcatgttctccattctccctcccaaccacagaatcacgtctccaccctctgcttctcaatcacctgtgttgactcctcaatatctaaaaagttagaatgcccccaatctcaatcccatgctccaaatctctcttctacccatgtcttcttcaataatgacatcacctacttccaagatggctgcttccaagccctaaattatgcatctgattttcttcttggcatctactcttggtgtctccaacttcgcatgcccctgctgccttccaccctgacaaacctattcccctctcagtcttcccaactcagtgcgtgcttcctccattcatcagtgtgctccatcaaaacacctgcagcactctttccttgcctccacatgcagtcatcaggaggaccagttgttctctccatctccactgcctcttccagagtcccagatacatgatttctggcctcaactggcctcctaactgatatcccagctctactgttatctccacaatccatcatctacacagccagagaagttttttaaacaaaaatcagattccaccatcctcctgcataaaacccttcagtgatttcccctttgacctcttatacctgaacaaggtcctgtatgacttggcacttgccatatcagacaatgctgccctctgctcactctgcgccagctatagtgaccttcttcctgtttcccccctacccccaccctaggccagctggttcccacccatccttcaggtataagctcaaatttctcatcctcaaagagactttccctgtccattcaatctaaaatggtacccttcacattttctgccccagctatttttgatcatatcaccatattgacttccttaccagcatattttataatctcaaccacgtcatttatatttctgtatttgtttgagtatcgtctttctctcaactaagatctgagctcccagagggcagcaatctcttctaatttgcaatctcttctatatgtctagtgcttacagtctgacctggcacatagtaaatattcctcagatatttgcttaataattgaatgctgtttgctctggctagaacaccgtttccacatataacccactttgcttaattaatgtccatgcttctttcagatcccacctctgaaattatgcttcagggaagccttctccaacttcccataaatgcctcaagttgacatattcatgttttcagaatcctacataacccgccccttcacagaatttatcatgtatgtaattttacatttactatttgattaacgtttgagtttttacttaatattatatctccagatcatagctcaatgtttgacaaacataagcatttgtgaaaatcatgtcaaataaataattttaaataaccatgaacataatacctactctacaaagaaattctgtacatagagaaaagcacaccaaagcatacctatcaagatagctacctatcatttcaccaacagggatccttgctgtgctgtatgtccttccagggatttccctattatgtatatgcatacatatttttatttctttatctacaaaactaggctagtatgtaagattaattcccatgtgaatgtgagcctctgctctattttgtcaacttggaattcactattttccatctttgccaaattaaaatttaaaaatggtattccattactgttttaattaatattcaattctagtaaagatgaccattttttctatatgtttattagcaagatgtattttttttgtggcttacatattcaaaccctttcacaaatatgtttctggtgtattcatatttttattttcattcttgacatataaaaaatattagtccttcatctgtactattgtatgctgcaaatattttctttttttttaattttgttattattatactttaagttttagggtacatgtgcacagggagggatagcattaggaaatatacctaatgctaaatgacgagttaatgggtgcaaacattttctagttgatcatttgtcatcacattttgtaactgacatgcagaaatattgaccttgttatattgtcaaatctattatttactgctgtggctattgttttgcttgttatgatcagagcagtctttactgctttaaattacatgtttacttaaattttcttcaaataattttatggttttaacttttttacattttgttttctaatccacctataatttagagtaaaacataaagtgggaatctaattttatatttttctaaaggatttactaattattccagcctgtcttcaactaaattcaaatgctaatttattcaaattctaaaaataatgcatgactgtgtttatttcttggtattctttttagttttggtgccaacaacagattactcatattagaggcatacatttaaaaaaaaatgctaatgtttggctattttctcttttttttggccttttattatatttagttacatttgatttatcatattttggtgtccctcagtatgttcctcttattcttttcttttattttattattattatacttcaagttttagggtacatgtgcacaacgtgcaggtttgttacatatgtatacatgtgccatgttggtatgctgcacccattaactcgtcatttagctatccctccccgctcccctcaccccacaacagtccccagagtgtgatgttccccttcctgtgtccatgtgttctcattgttcaattcccacctatgagtgagaacatgcagtgtttggttttgtgtccttgtgatagtttgatgagaatgatggtttccagtttcatccatgtccctacaaaggacatgaactcatcattttttatggcagcatagtattccatggtgtatatgtgccacgttttcttaatccagactatcgttgttggacatttaggttggttccaagtctttgctattgtgaatagtgccgcaattaacatatgtgtgcatgtgtctttatagcagcatgatttataatcctttgattatatacccagtaatgggatggctggatcaaatggtatttctagttctagatccccaaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtcagttcatatgcttcacctactttttgagggggttgttttttttttcttgaaaatttgtttgagttcattgtagattctggatattagccctttgtcagatgagtaatgtttggctattttcaagtgtttattattccaaagaatttaatgagtcagattctgatgcatacattagacctgtgattcaagttgtattagatttgacatctttaaaatagtgaaccatcaaatttttgttatgcatcaccatttattctgaactctttttatgccattgaatagtgttttatagttttgtttttataggttctgtaatttttcctaaatttacttctagatatttgcagttgaaattttaaataagcttgtacattataatttaaaagtttactacttgtatattaaaaagatgttgatgtgcatttattgaaggcaactgagagtttttcagataattctctagttttataggatgaaatatccattttataaaccacataaaaagatagtttggattattttcaataattggatctaatgtatttttcttgcctgaatatattggctaaaactttaataataatatttaatgattgttgtaacaaacgataatatttaatgtcggtttttctcctaaaatacaaaactgtttgagaggaatcctttaatgtttattttgtattattacttaaaccagtgcttctcaactaatggttataccatccaaataaatagcattaatttaaaagaagtatccttgtagtcttcatttactgtttattccaagaatgtttgctgaattttattaaacatatttcctttttgtgccaaattggtcatgttcttaatcttcacatctggtattaaggtaaattatatgaatggattatttcatttcaaattatctttgttcacttgaatgaaacacattcaaacatagcttgctttgtttgttgcttttttatttatgattttttacattctatttggatgttttctcagttttcttttttgagttattttagtagctataaacaagtgtaaagattattttaggcctgttcccttaaattaactgggaatagattatataacataggaattatttgatattcaactgattggaagaacatggtataaatttatgtgagccaaatgtatttttggagataaatctttgataaatttatatctttcactattccttgttctttgttttattcttctctagccaattatgataattctaaattatcgttaaaaattcctttttataaagtatttttctcagaaatgttaaagttgcactatatagatttatattttttacattataactctaaactattctgtacttacatttgaactgtcatttctcattttatatattggggttttcttggtatgattaaagttattagagattaaaccactacctctttttaaaaatttaatcttactaattttctactttctatttcaccaatttctgcctttttcttgcattgattgagttcattagacttatgggttattttgtttctaatttctcatattgacagttaatcttctttgtttagaagaattttttgtttagaataactgtcaatatgaaaactgtcaataagaaaagtttgtttgcttattcaatcatgaaagtatttaatgtgatgacatgttctataatatctcgtacgctatattctcattattgttacttcccagctattctgttggtaaagttttgatattttcttggatataaaagttatttagaagataatttattataccttttttcttgtaagaaattaagattgttggtttatattttattttaatctccatgtttattatattgtgatcacatattattattaaaatttattaaggtaattatggatatatattttttagggtaaaggagtagtttgatacataaattaaattgcttttattatattattcatgttcttcttgttttctttaccttttttaacctaattaaaagatttggaactgaaagagataaatacgtgtcttagatcgtgatttttgtttctgtcaatttcaccttacatttcctagagatttgctttatatttctatattgtattatctgctgtaaaacttttctgactgttagtgttttgctatgattgaaggctttactaatgtaaattataattatttaaccaatttgaaacatttattttgatttttacctgttttgttaataattttgaggctcctttattttgttttagatgtcaatgatttattcttatccaatatttaactttaaatttctcctagttggttttaagttttcctctggtaaaaaagttataattatattttgacttttaacccaatttttctatatagcattatttttaacaaatattttgtttctgtaactggcaaatttgtacttactttcttatttctgtttgttttaaatataccttttttgttgcttttattcttttaccatttcattttctttttttttctattttattatttattttatggtttctttcatttttttcccactggtgatttggaaagtatatatgctattcaaaattctagtaaaacaaattaactcatatttacctcctatggctatagttccagatttttatctgataattttgaatggtgaagattcatttatgtgtcatatttgctaagctattatacacagttactcaatcaaacactaatctaggtgttactgtgaaggtattttgtcaatgtggttaacacagttgagtttaaggagattaggccacccaataatgtgggtgggcctcatcaatcagccagaagaccttaaaagcaaaagtgagatttctttggggaagaagaaattctgccttaagacggcaaaccagttcttccgtactttacaacatactggcctgcttacagatttcaaactctccagctcccataattgtgtaaatctatcccttgaaatacatctctttatatataaatgtatgtatattaatatttactatacctattgtataatttacatacatataacaggtaggatacacacacacacacacacacacacatgcacataacctactgattatgtattttttgtataaagagaactccaactaatacattaacttttcaagtgttatgtcatttcttttacaagaacaattattagaatttgttttaggccaggcacggtggctcatgcctgtaatcccaggcctttgggaggccaagacgggtggatcacctgaggtcaggagttcaacaccagcctgactgacatggtgaaacatctctactaaaagtacaaaaattagctgggcatggtggtgtgtgcctgtaatcccagctacttgggaggctgagacaggaaaatcacttgaacccaggaggtggagatcgcaatgagccaagattgtgccattgcaatccatcctggccaatagagtgagactgtgtcaaaaaaaaaaaaaggaatttgttttgttttaataaccatagttacactataatatttaaattatttcagtgcttcttagttatttatattattctcaaattttatttctgttcccaaattttaagtttagtttaatctctttatttgaacactgaattttcttccattttccacatgagcgtcttagcagtgtgtccaattctttggtcacaatatttttttccttaaacatttatagatgtggcatcacgatcttcccacatgtgatggtgtagaggtgaatgctaaggctagaaagcttgatgttcctttcctttactttttgttcactctatttttcttatactatgaagataatgtaataaagcaatcaccatccttgatattaatcttttctaataaaatgtaactattcccatattttctatgtgtatttcagttatagtgttcattattctttctgttgtagttattctgagttcttactaaaaagacatatgacccatagatagcttttaattttctgatctctatttctagtactttatcttttgttatttttatttcctagtcttatcctctgtgtttggataggtctccatcagtttgttcttcattttacctattctttgaggaagcaatgactctgttctttactgcctccaatgcattattaaatttcacaatatacttcatatgtttcatctccctcctattttatttctgtctatatcttaatgaggtaccttttcagcttagacatagtattcttacctcatacttcatctcttatctcatggaattcatatattttaagattttatggacagcaataattatgtattatctaaaattttctcctgaaataaactgtgttcctctattaccttttgcatgttttgttctccttctgttatgttatagagatattttttaaattccctataatcgcttatttttctacttgctcatcctttaattataatgtttaacctaaaaatcagtttcatattgtaacaaaatctcaagcagaagcaacctaaacaacaaccaagaaaaagccctaagttactctcattccttacctctcatttcctgaggcaatatcagctccaagatgtgtccaggagttcttaggataagcactgtaaagatgaactttcccataaacccctgaaaataaaaggagtaacagttggatagaaaaatccttcagaggaatgaaagccaggtaagtaaaagtcattccagaggctgttgtgcaaaacatgtgatatagaatctctatatgaaggtcccatattatcaaaagcattatttaaatgctctattttacaatactaagatatatctcacatggctatgaaatttattctctcaaatgctatagaaaaaagaatgctacaccacatcacaataatctaaaaggtgggaaaatagaccactctaatgactaaagttgaagaggtactcctttccactcttacgtgactccaaaccatttgcaattcttttggaagttaaccagttttgatattttttgttacacactaggttctccaaaagcatggttaactctatttccttaggatagagttttggagctattagctttatgtttagtggctggacttaatattttgtcttataaatatcaagggagagatttctaagtcctttgtttcaaaatgcagtttatttcagactaataaattaaaggcttaggagaaatgtgcttgatacagctcagttttattttttcatgtctttcttcctatatgttttattgccattttcaatcataattcctcatattctagtggtttaaaatgttttgaccatgaacctcaccagaaaaagaaaaaacatgtgattgtgtactctcagcacatatatatttattttatttagataactcagatatttatatttagataaaaaatatacacatatatgaatatactaatatatattggaatagaagttctaatattttattcctgcacccaaatgtattgtctgcatatccctggattgatgcactgtattttattgcaagtcattaatctaaaaatttaaaaattttacaattttcatcagaaaacatagaaataaaagaagcaggagaccactaaggtacaaataatatgactttggtgttcatctgataaggaccaaaaaaaaaataatcccaattaattagaacttaaccaactgtttatatcaacatccacattttttccatatatcaactatgaaaatgtcagaagataagaaaactaaatcaggataaatggatataaaaagaaccccattttcaggacgtgtcctgaaaccaatctttcataatagcatttatatatttcataagacatcatcatctaaaaccaaaatccatcttttttcactataggctaagtaagctaggctgagaaggatcctgaagtaatttaaagagattttcaaccaaagcatttataacaaaaagcagttcatgtccttaaatttgaattatccagaaaattcaattgaccagaaaagcagatttcttggtcatttccaatcatcaaaggtttactgtaaaatgacaccatttcttagttgtttcaagaagattacaaatgatttaatacgattaaaatttgtcatctacttatgatactacaaaaatttgagcatgcagtaaaagaaatacttcattctttatttcaatttagtatcaaagaaaatttcaaagacactagtttgaccgtacagccaggatcggggatcagagcaggcatctgtggatagtcctaacagaaagtttgttccagtgttatcacgctacagaaaagagtgaataccacaggcaaaagaagatcaaatattcttataataatccatctagtttgtcaacttagaaaaattaaaacattcttgaacctcttgttattagaaagataaaataaatagcatgcatggaaaaaacctttggaaacttaaagtgctatcaaagtgttatatgacaatagttatatattatggaactaagttaagaaacttcatactagcttaacattattgcctccactctattgagtactgagatccagagagggagccattgactgctaatgaatattaaatttatatctcatagtgttcagaaacctcagaaatgatggtccttgctctttttccacaaggaaaaatgacttacttgaaaacctccaacacagcaatgcatctaagggagaatccaagaaaattaacaaccaattttctttaaaaatgttcatattttttcttttagttaatttttttctcacttatataatagttgaaataagttcactatattttattattcttttagatattgtattgtcacatagcttaaatatgataacatatttattattcttttagctattgtattgtcacacagcttaaatataataacatatttttaaatataataacatttaagctgtgtgacaatacaatagctaaaagagtaataaagtatagtgaacttatttcaactattatataagtaagggaaaaataaccaaaaaaatgaacattcttgaagaaaattgcttcatgccaagagttatccctctttacttataaaattagtaatgcccatatagaaaaagtgagaaaatactttaaatctgatgaacattctcttatgcctcaaaactgagttagttggggatacatacatatggttatacaaggccagtccccgtttctgtacttttacatagaccaatttaaaatagcatttggtattgtggcaatagcaaataaagaaattgtcaacagtgaatgttccttattaatttatagatctatcagttgtataaatgtatcaataatcgagtagtatttatagttgataatattgactcagtcgaaactttagtgtctgactaatctggatcttaatccataatgctgacactataaagctgtgtggttttctgcatgtcgttcatcatctctgagtcttagttttgacatctctaaaatggacactactcacaagagagctggtaagtgaaataataaatataaattgcctaaaagggtgtttggaatttagcatatgttctatgaatagtatttctctatcagacacaagcacacaatacacacacatgcattttatttttaataaaaactatattatactcttaccaattgttcctgggtcaatatgaattccattcatacggtcacaaaagactccctctgaggctctaaggagaatcagaagcttttgttccttttctaagggattttctaaagtacctgtttacaaagaaaagtatatcattcaaatcaatttgaaattaaaagaaagagagggagaaattgcagtataatttcaataatgcaatgtagatactgtgaagtagactatatggaggagtcaatggtcatgcagatgaaataagagtaggataaaaaagattcagtaaacttctttgaaggagactcatgtattattcaccaggtattcactcttctttctttattagggcagtgtaaactttcctgacctactaatatttatcctggtcatatgacttgctttgaccaatgaaatttgtgtgaaagtggtaggaatattagttttcagttgatgctttaagggacttggcaagttgttttgttttgttttatttcattttttaccagatctctttcaatgttgttctctaccatgaatacagaatttcttaaatagcctgtggtatctgaatgaagagatatgcagagcaaacctgaatagaatgcacaagctggagccaagttcaactaagtctaacacaaatatttcttgatgtaaaccactgagatttggggattgttacacaccattattatggcaaaacctgcctgatacactgtctatggctagataaccttcaaatctctttatatgcattttagcatttactcctcacaacaaacctgagaagtcagtataattattatcccagttttaaatatttgcacataaagaggcttacaggttaagggacttgtctaaattgatccaactattaagtaacagaatctatttgaacacagatctgtttatgctaagtgtttatttaacagataagaggttattttctaaaactaaattcttttagcagcataaagactcataaagacataaggctatgatactcagacagcagttggaattctttctgacctaattttattgatgttaacagtggagtttggtatgaaaattcatacttctatggtatgagaattgttcagggaatttgtcaaattagcgttagtgagtatggacctgaggaaggttagtttcaatggaacatatgtcttagagtacaaaaatactaaagttattaaagtcagttgtttgagaagtaactggtgggaaggtaatcccaaaattatattccaaatcagacaggttaataaaaaccaccggctatcaaatgcgacttcccagtatataaattcccgaaaagataaccaaaaatgacattgctaaatacaatgtgaaataactagtaaacttacaattgcctggttttcatcttggttgctggtcttttgagcaacataaaatcatccccccttgctgacacttcctatatacctggatagccaaaaggcacaaggtaagtctaaagcttgctacatacctatttttatagttcagccttcacagccattactctagtactctgctgaaagcaagcaagattcagacaggtaagtaaatctgcctagaggcatatagtaggtcaatgggtgagcaagcctatgtatttccaataatatgcaaaggtgtgttgctcctctgtgtaggtaatgccactcctcagctgagagcctgatgcatcatcttagtgaaaataaagatgtgctagagcagaaagaagggaagcaggggaggatgaaaatgtttagtaaatgtgtatggcgtagctgttatcttgccattacaagtctgtccagtaagctgttttccaactgtgatttcatttatttcacggagggtagtttagagtctttgggaaaaaaaaaaaaaaaaaaaaaaaaaaaaaaaaaagtggcctagcactaaagagataccagagagaaaaaagtaggacagtttttgccctagagaaatgtatgcagagtcccacaaaaagagttcagcgttcctctaaaattagagattaaatcaattatgcaacccaacactgcagcacatgtggagctttcgcagaaagtctgggcaaaattagttagcctgccgtgatattttgctatctgcaatggccagaatttggcttcctttttgtaactgagagaaaacgaaagatgaagaatagggactaagtacaaagaaggcaaaggtgacctaagagaaggaaatacatgctattgcaacataaaaatgaaatgcttcttgaatgtgtaaaagctgataaatggaaagctttaaaggctgagatcctcattttcttctcaatctagcaatcaaagaaaggtgaggtgctctctccagcgtggactttgcccctaaatgagggtagccacctctgagacagaagatgctcaggatacgcagctcatccttggtttacctttgtaaagcttctctaaactatactaagaggcatattaaacctgggcaaatttatgtattcataatgggaggaaaaataattgtcattgtgctgcaaagacattccggatattttcacatgcacaatttaattctcacaattttatgatgaatacagttgaggttctgatgaggaaactgaggcaaagagaggttaagtagcttgtcaggaatcacacagctgttaaatggcgaagttgggccttagacttaataagtaccatcctaggacgtgtggatatggaggaatagaaaagaagtaaagggaagcaggcattacttagtatgatggtgggcagtgaaggggaaacaatgtgttccagatgctaaaatcacctggagagatggtagaaaatgagttctggcatatgaaagataatcattataattatttggggaatatggtacaaatgggttccaggaacttcaaaaggtaagaataagaaaaaaaggcatttcattattttattaactaaagctctttgatggaatcaagtataatcctagtttgcacttaagcccactctgtcaacatgactcaccagaccttgtaccaagccaacccgtaagaaattatttacccttccttcaactcactctcctctgtgctcatgagatttcccagcatttatgttttaccttcatcttaactaactctgattcatccctcaaaacttggctccaccgtaatttattcctaaaagccttctatgatcttgaattagatgtccccttttgtgtgtaaaatcttctgtaccccttgctaaagtaattctacttcaagaaacttgtcctcaagaactagtaggggacaaggacaaagaataatgctcaaagttctccactgcagtgttatttatttataattggcaacatttaaaaacaccttgaaatagcaaacaattagaaatatttttgtccattttaaactccttcctttcttcccagactttttgacacacttaatagctgaaacatacaagtccccaagcaaccatatactcccttgcctctgcccccctctgccttcattcctgtttttgtcacggccaactcttacatactttcaaacccagttcagatgccacctcttctggaaatgcccttgtcaactaagtctgggttaagtgaccttctaagggctatcacagaatgccatgttttgctacaatacttctaaaactatactgtaagggccatttacctgattgcctccttctctcagtgagcgcaagaagaaactatgtattcccagcagagtttatttgaagatattttattccagaaatgtttaacttggtaatttttaccaaccctcctggagaaaacaattggaataaagaaaaataccccctagtaataaaagactaatttcaccagtaaattacaacttttaagcatttatgtacctaccattatagcttaaaaatatatactgcaaaaatcaacagaactacaaggacaaatggatatacctataatacttgtagtaaagccaacacaactgttgctaaaaaaaaaaatacaataatgatacagcagttttgaataatgcaatttgcatatttgacataacaggcatagatggaaaactagacccacaaagaatgcgcattcttttaaaccttgcacaagacatttaaaaaaactgatcatatgatgatgataaagcagtttaacaaatttttaaaaattggaattatacagcatttgttttctgactatagttccatcaaaatttacaattcataataaaaaaatttcaaaagtgagctatattaaagatctttccaattatcaaagaataccattaagaaagtaaaaaagcagccagatgtggtggctcattcctgtaatcccagcactctgggaggccgaggcaggcagatcacaaggtcaagagatctagaccattctggccaacatggtgaaaccttgtctctactaaaaatacaaaaattagcttggcgtggtgcgacgcacctgtagtctcagctactcaagaggctgaggcaggagaatagcttgaatcccagttgcggaggttgcagtgagccgagatcgcaccacactgcactccagcctggtgacagagaaagactccatctcaaagaaaaaaaaaaaagaaagtaaaaaagcaagccacagagtgggaaaagacatttgtactacttataaccaacacaagatacattccaaaatatataaatgactttgataaatcaatataaaacaggtacattcatcattaaaaaagagtaagagaacagctatttcacaaaacaagatactctcaaataaataataaatacattctactatgctcaatcatatcataaaaaagaaataaaaattaaaacaagaatgagatctcactacatatccagtagactggatttataatgtttaattaagcatatatttttcattttataaaatttgttgtatatgtgtgtcattttccacaattaataaaaatatgttaaatgactatgttccgagaatactcttcaatgagttttgttgatcaaaagaggggaaactggccaaaattttagtcacatcttctgaatatactattttccaggtgctagtcactgaatccaaagcaacaaattgtatttttatataatttgtatttttatctgagttaatcttaaaactctataaatatcacgactgcacatgaaagataaagaaattacccccaaaataaatttcgtacatttttcccttgtcctcagaagtgggttaaatggtgtttactttggaagttgagcttctacccaaagcataaccatttttctcatgccctgcaatagcaattttctgaagaccagagcctctagaaccttcttactatcatataaacccaagctggtaaatagcactcaaccaagtaaattgcagcacatatttttttctgaattagcttttaattcccagtgtatatttgactcgcttattcctaaaacattcctctccagtagaactgattccatctgaaaataaatgtagggtagaatggggcttgcagtccagtaagataaaaattggttataaaaatcagtaggcattatcaaattataatgtccaacccctcataaagtgattttattcaggctaacaaattttcatttttaatgaggcctctcaatttttcaattaatggaatattaaaataaacatgaaaatatgttattcattcactacttgcaaaatgtacaaaaattctgaaaacttcctccataaggtcgagcaaattacctcatttctttaagcctcagcttcctcaatgataaaataggcacaataatagcatccattttttgtgaggttaaatgatttagtccatgctaatagtatatggcacagtgtctgtacataatacatgtttttaaaaaatgttggctcttagcaatattaataatagtagttaaaaaaacagtaatagtaaccatggaggtatcacacttatttaaaattaacctttaaatttgaaaacttaaaaaaataaggcaagctcttcctagcaagtaatatctaattcctaaagtactagctagacactagacatttcaaagcaaaaatattaagtgactacttatttcaatggccagcccaaggaacttcagaaaacacaaagtttaccttaaactgaaacattcctgtaagttttctaactaaaaaaaaaaatcattcattcatttattcactagctttcctaaaattattttgtttgtatgcaaaattaaatagtttataataaatttatatgattaattattttaataactaaataaatccttaagaaatattatattactgttatatggattcatgaatcaaaagtacagtttaagaaagactgatttaaaaattattaaaataggaaagatgattactgcaaatgcctttagtaaagactaactgatgtcccaataggacagaagaatatttatttgtattagtgtttggcttaaaaaatatattaaaactacacacacacatatagatttaaggataatgtgatgttgtgagagaactaatatccatcagaaaataaacagatctttctattcttaatatcattttgaaataagtattatttaactgttggctgccagccttattagggactctccaagcacagaaatgagttttagtgtttcctgaacctctaaggggcaaaggttttacacttttgctcctggttaaatggagcaaatggttaaatggttaaataagtaacagcttcaaaagtcacatcccttttatgtcacctttttattttatcaaacaaccgttagtttgattagggaactgtgcatctaaataaactgaactaaccatctattttgcaggtatctatgtacacttatattatacacattgcatatgtgggtatttgtgtcattttctaatcatagttaaatctgaaggaggacatacttttttaactttgtatatttttttaaatgaacatcacatacaagattctctctggctgctcaatgggtctgactactgggtattgtggctttaagctggaggatatgttttaatctacgcttttctcaggtttgtctccttcttattacttaatcatccaatgagccttacagaactgtcagtttgaaaggcaataaactgtgtatggatttttcttcttctttaggattgagaaagtcccaatcatggaagcaatgaaagaaacttccatatacctagtacttcgtttcctgacaatcaaaggcacgtgctaatgatgaccttaggcttctggctacaaatgtgagacagggctgacaaatacccatcactgaccctgaaaaacaatatgtgacaagttttaggataaaagcccgagtgcctaggataattactgagcaactagacagtgcatcatgtgacctggttgtgacaggccaaagaaacaatgaactgctgtgtccccagggataccaatggttggggcatatcttgttgactagggatcaaggaggtttctattaaactttaaatatccattaggatatgtgtttcaaaaatgtatttttacaatacaaataaattttataaaattatataaatttattattttataatatttaaatactatatttattttatattattttaataattaatacaaatgtattattggtaacccctatctgaagtccttctaaaaatattaaaagaagatttttcatttgcagttttaaaagtacaatattaaaacagtctttattgagttgactgtttgggtcaataacaagttaacagcattgatatctaaaacaacaaggaacatatttgttaaagcatgagaacaatgtctcatataagaggagacattgatgaaagggatgggctcagacagctattcatgggcaaagcttttatatgtttaaaaaaacatttaaatcaaataacaaacaaatgtttattgaacaagctttgagtgggggacatttttaagtcagtttcctgttctaacagattgtaaaaatgaaaatactttgaatcctacaacacatcaactttttaaatttgtttttgtaactccttttttcctttcacataggggataaatatattgtagtcatttaaacattaacaccataatttcttcctcacagatgtagacatttaagtgtaaggagattgaatgttttccaagaaaaaggcagtgagctgaaagacaaacctaaacatgcccattcacttatatatacattgtcagtcataacagcatattatcagaattctataatgcagtaggtactagggttataaaatgttctgattaagtctatcatataatggagataggacactaattaaaacatgctattcatatcattaccgaatgcagtaatggcaacatgaatgagtagcacggatcagaaggaaaggtaactgaaatctactgcatggagacaggagaggcttcatataggttggtgcaaaagtaattgtggtttttgccattaaataataaaggtagtccttgggcaaaggcttgaaggatgatatttaagatagctaaaacagccatttgtcctggtcctgttttttgtcagctctgagaccttgaaacaaatcaattatctctctggatttcagtttccttaccaataaaacgagacagacgtttcaaacaatcacagagatttgcaacatcacagttatgaatcttctattggggaattttccagaaattgtacaatgagttactaaactaaaatcacaattcatgtctctggaatttccatatttatgaagctaatttctgtcttgttaaagccatactcaagagactatcaataagtagcaattctcagcataatttggactcatttagaaagcaacactgtatatctcaaaatctagcccatgaaactcatgacgttcactataaactcactactattcactattctttagctacaggggctgcctttctgcctcacgactaccacacaaagcacatttctccctcgggacctttgcactagctctccctcagcctgaaatgctattgttcaagtcttcgcaggtctagctttttcttgtctctatagtctgatgtcacattgacttgttagaaaggtctttactatctaacatatggttgccagcatccaacctggacctctcattaattacttttcctatttaatttctttcagagaatgtattaccatctaaacttatcttcctcatttattttactatttaattgtctgtttcccccaataaaataatgcaagcaggaattgttcactactgaatgtcttgttcactgtggaatattcaaatgacagaaagaatgcctgaaactgagttggcattcaatgaaagagggaggtgggaggaggtaaaggaggaagggacaaatctacaaaggaaactttggaaaatcaccatatcagaggaattattttctccttagtatcgatctattcatttcatttcaccatccaaaagaaaaccagttattcatgaaagcaatcctataaaggtttgatgccatgactcaatatggacaactattcattttcaaccatgaaattcaatatgttcaatgacacctcaggctatatactaaagccaaaaaatgaagttgttaaagaatagataaatggtattgagtttatgaaaagttattgctcctgaagcagtaagtgttgcatttttatttgttttacatgaaaagtaataatttgtgtcaaaactgtatttatcagccattataaaaaacaaaaagctggaataagatggccaattttcttttctattttctttgccatttccactgtatctcatattactgactacttcctcttgtaaattgcctcttttgtttcaagatattattttcctgtcatttcattttctttccacctatataactgtttctttttcattcttttcctgaactcagcttcctctaccacccttcaaagacttgcgctcctcaaaatttctatccacaaaatctgtttggccagttttattcacacttttaatttcacatttgagctgatgatcctcaaatatgtacatttagcgcagacctctctcactggtttctttattcataaatctgcttgttctctagatattatcacttagatctttcactgaaatctaactttgaaatttatgagtctgggtacttaacaaaccaatgtataaagtttactgtatactcaacattgttcaagcattttaataaacattaactaatttacttttttaaaaactctatgaaatacgtactattattatttctactttggagataagagtactgagacacagctagttcatataacttgccgagggccattcaactaatgagggatggaaagggcactcattcctggcatccccattggcccagatctcccaacccgaaaccctggatatatcccaaataactcttccttgcctcagatcaaaattctcactaggttctagtgatttttacctcctcaatgcttctctaattaattctttactctttaactcctgtaccttacttcactccctgacgatttctttcctgaaacatctcagtaggcttctcacttttcactgtgtcccttttaagtgcattctctacacttccagcactaatttttctaagaataaatataatcatgtcacttccttgcttaaaactatccagtgactacccactgccttcataggaaaatccaaactccttggcatagtatatcaggtcaaggtgcttcatctactaccaccatttcatacaaagcctacaatccagacatacccatcccctacagtttcctaaaagtataatgctcatctaaaatatgtacctgttcacatctcttcctttatctttaagctccctctaggttggaagacatgatccttccaatcatgtttttactcatttgtcacactattttattgagacacctcttgaaagttcaggttcatgatttctgtttctatatgcccagtatcccccatggtacttggcacatggcagacgctgagtaaacccatgttaaatgaaagaatggacacacatgtgaaattctttaagcttatcttaactgttttatcagactaatgagacaagcactgaacgaagaatgaaattgagtttggcatttgtgatgcagctatggccctctaagcaaagctttgatcttgagcttcctttctaattctagcattctatgattcaactctattaaaagtccattgatacccttgccagcaccagttgccttacaagcaggaccaccggctgggcatggtggctcatgcctataatcccagcactttgggaggccaaggcaggcggatcacgagttcaggagttcaagaccagcctggccaacatggtgaaaccctgtctctaataaaactacaaaaattagccaggcatggtggcgagcagctataatcccagctacttgggaggctgaggcaggagaattacttaaaactggaaggcagaggttgcaatgagctgagatggcgccactgcactccagcctgggcaataagagcaaaactccatctcaagaaaaaaaaaaaaaagcaggatcaccaaaaaatataattccacaatgttgggacttggatcaaatggcatcagatagcaggcatactctggcagcactctgtgccaatgtccaaatctattaagtttgtttactaactagtcttattatctgtttcatgttgggatttctttaggatgtggtaaaattggacagatgggttgaaagtcttccttcaggcacaatacacatagcattgggcagatgggttccaataacctacctttaggcctggaacacatggatgaaacaaagagaaaaagaatacaccactatccagtgatgggtagaaaatagaattgggaatggagaaatttttaaatgagacctgaaatatataaagtaaaactggaaagtggcacagtgtcacttaccttcaaaggtacaaatttttcagtcagcaagctatatattatagtaatgagtgaccttagaaatctaaatgtaacttactgaaaaaagagatcaatcttagcaataaaagatatcaactggaaataagttttgtagtaacaagaacagggctcaactgtatttaatatctctcaattaattggatgaggattttacagaatagtaaacaaatgggcaaatggcagtaatctgtgaggaaaagaccagacttcaagagaatatctgcagtgtagaaagatgaactgaaataattaaatgaagggataggtaaaaagtattgcccttagattccctcaaaacccaagggaaagcaaaatcagcccaatacaactgtacaatgtagagatatgtatttgtggcagcacaaatataaagagcaggaattagagctgacagtgtagttggcaggactaatggcatgacctggctggaaaaagaagttagtttaatatttgactgtattaacagaagaatcatatctgttctgatagctggaggctgactatgctggagagcttctgttgacacctccatttccaaactctgtgcttctccaccctacccagtgccccaggatgtggctgacctatgtgtactgcatcaaggagttctcctttattctgacttctcctttattctgacttccagtcggatgtggccaaatggtagcacaagcagaagacaggagggaaacaaaagaatgaggtaagagtgtttattcctatagttccttccatgtactggttaaatcccagccatacaaaggccatgcctctgggatggtctgacaaccatctctaaacctccctctttatctctgggttcctataacattcttttctcaatcctttatggcaagaggtagtaaggataactggctttatgagccctagggtatacctcatcccatttggatctttgtaaatcatttctttatttaaatcccttcaaactgtctaatgcatatgacatatattttctgtgggcaccctggctgataaacatttattgaacacctactacataccaagcacttcctatgagttatgtttaatatccctctgaagaaggttctactcttatcccacatatgttgcagatgaagaaatgaaggtgcccagaggttgacttgcttaaggtcaaacagccaacaggtggccaaggtggatttggacccccaacatctgacttagagcccattctgttaactgctatactcatctcactctgttcagaatagtcagatcccacctgggaatagttctttctccctggctttcagaggaattaaacaaaacaaagttgtgtttagaggcaatgccaataagaaagagggaatctcataactatgggaaatggggtgtacaaatttgtaaaatttttctgaaaagcaatttggcagcatgtattaaaaatcttaaaatatgttcttatccttaggcccattaatttcatttttaaaagcccatcctaaggaaatgaagatatgaataatgatttaattattgaatgttcattgcagagtgagttacaaggacaaaaatctgaaataacttaggtgcttaacaatagaaacatggctaaattattatatatacatgtatatctatatattcccatatattatataatgttgaaattattgaagttgggcctttgaaatataatgagttgtggaaattcttacattgtttatacaggatcaaaaaaatcaaagtatgtaccctacattttgaaatacatgtgtgcatgtgtatgtatgtgtaagaaaaaaaatgactttgagataaaacaccaaaatattaattgtggttatatttgcacttggaaatatttgcacttggaaactttgagtgatcacttcatttccaccacataattctctttgtttttctgtgtttgcagttttgtaccatagactaaaaagaaatacttaaaacagcaataactatgaaccatggttataaactgtatgacctaaaacagaaaagattcaaaaagatgtgaatgaagggctatagaattaaaaggagtaagatacttgtcctgaatggctcaaggggaagagcctgaacctatagaaattagaggaagatagattttagcttaatagaacaaaaagaattctaataggattttaaacaatgggaacaggttgccttgaaaggttttgatttttttgtcactggaagtattcaagaaaaggattgaccatattttttcagaaatatttttacagtaacttaacctttgttcaggtaattagacctagaattttctcccaactgagattctaaaattttcatgctacctaacaaggatatctaaatatttccttaccaccagagatatatttctttggaataagatatgatttttttctgggcattctctttcaatcttcttcctggggcaaagtaaaatgccttactaaagttctaaattagttcctttggagacagggtacatgtcttttcagcatttatacctattgcttacaacagttctaagtatatagtctacccataacatttcaggtttttttatttaagtaagccaaatctggttaatacactaccctagatccattccattctgcctgtcctgtggcctcaacaacatgatccacttcccagcaagaggagcctcatctccgagcacctactgattctctggtccttccactagctacccagggagccacaaaaataacaaagtcagaggagttaatggcatggaatgggccaggtgagatgcttgccttctcctcactacctcttccatattgtcccaagatatggtggttctaataaggcttctctcaagatatcccacataaccaagcaaaccaagcatgcttctttgagaagctgtggctaccttgtatttgctttccctccctttcctcctcacttttcttttcccttcactcacacatctttgggattatttgtcccagtaaagtgctagcacatagctttgctttcaagtctgttttcccaggaaattatgttaagacaacaattgaaattttattgtgagttagttgatcagatgatatcaaatccatcctatgatatcttctgaaagagcgagttaaaggcatattctgacacaaagaaaacctaaaggaagaattgatctgtagcctggaggaggtaaaaaatcaccctggaatgagcagtagcaggcggaccagaaacagcctgatagtacacgggcatgaaagaatgaccaatacaagccacctctgaccacatgtaaagcttgccgaagagcaactttactggtgcactcactactaccttaaccctccctaaactctgttaagcaacctgcttgatgataccatctgtttcccagagccccttctcacagaatataattctcaacatgctcgcaatccttgtgcctttactcaccaactttcagctccccgcctgcaatgaccatgcatgccacactcagaacattgcttctgtccacagggaagtctaaggtccccatcacatacagccctttgaagaatggaagatctgtatccacaaggacagttctgtctgtggaagaaaaagaaattgctcagatatgtcacaaaaacaagaattacgtgtttattctggggttctcccagcagtttgggagctgtgtacagtgttatctaaaccaggacaggtatagcaactggaagaacaaatagtctgccaaaagctaggacttactgaacaggaaaataagttctgattgataaatgctgcaattgcttaacataccacattcatggacaaaatgcactgcttatgcaccaaacagctgccccaagtctagtgcagtggaaacacacagatcgaatgagctccctaccctttgtcctgtctcttcacttttggctctagtttcagggatgtacagaacagtagacatgacattggcctctgagggaagactatttggatgtgaataccaattctgctacttactagctgtctaggcaaataactttatctctctgtgcctcggttatctcatctgtggaatgggaataatactaaaaacaactgtttcgttcacaggactttttgtgagggttaactcatttaattgagttaatagattgaaagtggttatacaatgttagtaagctatctctaattccctaagtcccattgtgtaaggtaaagtacatggtgcatgcttaataaacgcttgatgttattatttttactgttgtcccttagcttcccatgcttatagtgcttactggacaatttaaaatcattatattttatttcccctttcataaaagcagtcttcatataacttcagaagaaataatcatagctgttgcctgagatttactatagagtaatatataaacacaacattttcatttaaaacaataagtatttcatgtatgccaaagcattaagtgttactttctgaaatttagcagtaattcaacactataaatgacatcaaataaagatttttgcttaaatttctagtaccataatcaccaacacatgtaaagatttataaggaattcttttgttagtataatctcatctctcattctaggaaacaatgcacttgctcttcttaaggacatgcccaagcaaattaacttgtcatgagttgtctttcctagcccctccctgcttcctgcattataagaatggccatgccctcctgtggcagagactatagggttgtaaaccaaccatttctcttgttttcctaagttcacagttagactacagtttccacctcctttgcaggttgatgaagccatgtgactgagttgtagccaataaaatgtgggaaaaattaaagtatgacatctctaggcctgttccataaattctgtatgccttttccctccccttttctctcagttagatgtagagcagtggttctcaaagtatggtcctatcccatcaggatgcaaagcaagcattagttctgctagcaagctattctctctcctcactggctccaccactctccctggggaaacaacctctctcttttacactccagtgacaccctgtacatacatctatcagagtactgagacacattattcaaattatatacatacattattgtacgtgaggaagtaactgtcactgggctggtcctcagtgtgattatgacttcctctcccactctgacttccttaagtgaagagatcattctttttctttttaaatccctagtgtttttgcaatactgaagataaagacactaaataaatgtcgtccagatctgttgagtttaatcccctacataccttaaattcaagagctcattgatgactggtacaaaatgaatgatcaagctaaacagacaaaaataaatatatatcttaatctcatctctagcacttttcaaaatattcaaataaaagagtgaagtacctagagaatgttctaggtttagcacacattttatgggttcatgactttaagaattatttgaagcaaaatttgtaaaaacaagagggttttgcctccaatttatttacttatttattttattttcatcttttattttaaattcagggatacatgagcaggatatgcaggtttgttaacacaggtaaacttgtgccacggtggcctgctgcacagatcatcccatcactaaggtattaaacccagcatcaattagctattcttcctgatcctcttcctcctcccaccacctgccctctgacagaccccagtgtgtgttgttccctgccttgtgtccatgtgttctcatcacttagctcccacttacaagcaagaacacgtggtattttgttttctgttcccgtgttaggttgctaaggataatggcctccagctccatccatatccctgcaaaggacaaatgagataattctcattcctttttatggctgcatagtattccattgtatctatgtaccacattttctgtatccagtctatcattgatggacatttaagtttatttcatgtctttgctattgtgaatagtgctgcaatgaacgtatgcgtgcatgtgtctttaaaacagaatggtttctattcctttggttgtatacccagtaatgggattgctgggtcgaatggtatttctgcctctaggtctttgaggaatcgccacactgtcttccacaatgattgaactaatttacactcctaccaatagtgtaaaagcattccttttgctccacaaccttaccagcatctgttgctttttgactttttttttttttttttttgagatggagtctcactctgtcgtgcagtggcgtgatctcggctcactgcaagctctgcctcccgggttcacaccattcttctgcctcagcctcccgagtagctgggactacaggtgtccgccaccgcgccttttttgactttttaataatagccattctgactggtatgagatgatatctcattatggttttgatttgcatttctctaatgatcagtgatgttaagctttttttcatatgtctgttggctgcgtgtatgtcttcttttgagaggcatctgttcatgttctttgcccactttttaatggggttgttttttcttgtaaatttaagatccttatagatgctggatattagacgtttgtcagatgcatagattgcaaaatttttctctcattctgtagcttgattaccctgatgatagtttcttttgctgtgcagaagctctttagtttaattatatcccatttgtcaatttttgcttttgttgcaatggcttttggcatcttcatcatgaaatcttcacctgtgcctttgtcctgaatggtattgcctaaattttcttccagggtttttatggttgtgagctttacatttaagtctttattccatcttgagttgatttttgtatatggcttaaggaaggggcctagtttcagtttttctgcatatggctagccaattctcccagcatcatttattaaacagaatattcttcccccactgcttgttttttgaggtttgtcaaagatgagatggttgtaggtgtgcagtcttatttatgccttctctttctgttccattggtctatgtgtctgttcttgtaccagtaccatgctgtttggttatgctgtttggttactgtagccctgcggtataaagttgggtcacatgatgcctctagcttttctctttttgcttaggattgccttggctattcgggctcttgtttggttttatatgaagtttgaaatagtttttactaattctgtgaagaatcttaatggtagtttaaggggaatagcaatgaatctataaattgctttagatagtatggccattttcatgatactgattcttcctatccatgagcatggaatatttttccatttgtttgtgtcatctctgatttctttgagcagtggtttgaagttctccttaaggagaactgttcacttcccttgttagctgtattcacaggtattttactcttcttgtggcaattgtgaatgggagttcatttgcgagttggctcttggcttgtctattgttagtgtatggaaatgctagagatttttgcacattgattttgtatcctgagattttgctgaagttgcttatcagcttaagaagcttttgggctgaaacaatagggttttcaagctataggatcatttcatctgcaaacaaagatagtttgacttcctctcctcctagttaaatatgctttatttccatctcttgcctaattgccctggccagaacttccaatactatgttgaatgggagtggtgacaaagggcatccttgtcttgtgacagttttcaaggggagtgcttctggcttttgcccattcaatagaatattggctatgagtttgtcatatatagcttttattattttgaggtatatttcttcaataatttattgagtttttaatttgaatgtatgttgaatttatcaaagggcttttctgcatctgttgagataatcatgtggttttggtctttagttctgtttgtgtagtgaatcacatttactgatttgcatacattaaaccaaccttgcattccagggacgaagactacttgatcatgctggataaactttttgatgtgctgctgtattcagtttgccagcattttgttgagaacttttgcattggtgttcatcaataatattgacccgaatttgtcttattgtcaggttttagtatcaggatgatgctgacctcataaaatgagatagggaggagtccttcctttttaattcttggaatagtttcagtaggaatagtaccagctcttccttgtaactctggtagaattcagctgtgaattcacctggtcctgggctttctttggttggtaggctacttattactgccccattttcagaactcattattaatctattcagggattcaattcttcctcgttcagtcttgggagggtgcatgtgtccaggaatttatccatttctcccaaattttctactttatgtgcaagaggtgtttataatattccctgagggttgtttgtgtttctctggggtcagtggtaatatcccccttgttgtttctgattgtgtttatttcaatcttctctttcttctttattaatctagctagcagtctatttaattagtttttttttcaaaaaaatcctagatttgttgattttttgaaggcttttcatgtctctatgtccttcagttcagctcagatcttggttatttcttgtcttctgctagctttgaggtttgtttgctctaggttctctagttcttttagttgtaatgttagattgttaacttgagatctttctagcttttagatgtgggcatttagtgctataaatttctgtcttaatgctgctttagctgtgtcccagatattctggtatggtgtatctttgttctcatgagtttcaaataactctttgatttctgccttaatttcattatttactcaagagtcattcaggaggagaaggttgttcatttccatggtgttgtgtggttttgaatagatttttttttttttttggagacagagtctcatcactctgtcacccaggctggagtgcaggggtgtgatatcagctcagtgcagcctcctggattcaaatggattcccttgcctcaggctcctgagtagctgggattacaggtgtcttccaccatacctggctaatatttgtatttttagtaaagacagggtttcaccgtgttgcccaggatggttttgaactcctgaactcaggcaatccacccacctcagcctcccaaagtgctgggatgacagctgtgagccactgtgcctggccttgaatagatttcttaatcttaagttctaatttgattgtgctgtgctatgagagactgttattatttcagttcttctgcatttgctgagagtgatttacttccaattatatgatcaattttaaagtaagtgctgtgtggtgatgagaacaaggtatatgcctttgttttttggtggagaggtctatagatatctatcaggcccactttatccagagttgagttctggtcctgaatatttttgttaattttgtgtctaaattatctgtctaatattgtcagtggggtgttaaagtctcacactattattgtgtgggaatctaagtctcttagaaggtctctaagaacttgctttatgaatctgggtgctacagtattgggtgcatatatatttaggatagttagctcttcttgttgaattgaaccctttaccattatgtaatgcccttctctgtcttatttgatttttgttggtttaaagtccattttgtcagaaactaggattgcaacccctgctttttttctgttttccatttgcttggtaaatttttcttcattcctttattttgaacctatgtgtgtctttgcatgtgagataggactcttgaagacagcacactgatgggtcttggttctttatccagctttaaaagactctatgtcttttaattggggcatttagcccatttatatttaatgctagtattgatattgtgtgtatttgatcctgtcatcatgatgctagctagttattttgcagacttgtttatgtggttgctccatagtgtcactggtctgtgtatttcagtgtgtttttgtagtgactggtaacagctttttgttttcatatttagggcttccttcagttcttgtaaggcagatctggtggtgccaaattccctcagcatttgcttatctgaaaaggatcttatttcactttcagttatgaagcttagtttgtccagataagaaattctaggttgggggccaggtgcagtggctcgtgcctgtaattccagcactttgggaggctgaggcaagtggatcacttgaggctagaagttcaagaccagcctggccaacatggcaaaacctcgtctctactaaaaatacaaaaattagccaggcatggtgatgcatacctgtaatcccagctacttgggaggctgaggcacaagaattgcttgaacccaggagacagagttgcagtgaaccgagatcacaccactgtactccagcctggggtacagaggaagactccatctcaaaaaaaataagaaagaaagaaaaagaaattatgtgttggaatgtcttttctttaagaatgttgaatatctacccccaatctcttttggcttacagtgcttccattaagaggtctgctgtttgtctgatgggcttccttttgtaggtcacctagcctttctctggttgcctttaacatttttgcctccattttgaccttggagaatttgatgagtatgtgtctacggaatgatcttctcatggagtaccttactggggttctccgcatttcctgaatttgaatgttggcttgcatagctaggttggggaagttttcctggacgatatcctaaaatatgttttccaaattggtttcattctccctgtctcaaagcaagagttttatacaaattggtttatatctgttccaacctatagcacactcaaccaatattcagctattaaacctgattgtacaaaacaataaaattggttgaactaatgctttctctcatccacagagtactcacacatacacataaaagtatgatagtaggtgcttttagatgtatttctcagctaaaatatgacaagtacatgaagttttaattatacccctttcagaagaaattttccctttcaattgccctaccaactccaaatgtaccaacaaatttcccatgaatcacagacagactattataaccacttgagaacaggaacacagctgatgttctcacttttattttctcaggacctagaagaataatatttaacccataatagatggtcaaaattaacaccacacacacacacacaagcacacgtgtgtacacacacataaattccaatagttatctaaggaaaagtatagaatgaagacaataacagaaacattagtcttatttcttttggtgccacactcttcactttgaaattccctggattcatctctccattttttcttctttctttctttctttcctttcccataatgtgacaaattttgaggtggtaggaatttaaacatgagtaagtcatgtttcccaccatcagatgaaaacaggtatatatacaaataaataatgtgatatacttgaaatgatgacatactttttaattacatggaggttgactctgtttttattcccagctgcttcaaactggagtctatcaatgtgtctattataagaaaattctgctaaaataaaataagcacatgccatatagagatttttataaaggcattctccttgtatcacaataataaatatttcagctagttacatgagcaaaagaattcaccctaacgtaccctccagagcagatcatctgcaggtctaaactgacaaatcctcagctacaatgacacttgcagaggatttctctcttttgaggagtggaaagctggcatctatgtgccacattctctagaattaacatcctttccataaaattactcaagatatttcagagcaatcactcagaaatagttatttatacaacttacttaataatataagtgatggaccacctctaatttaagtgtgttccagtgctttccaccgtgtcctgccttggctacagatattccaccctatcctgtcagtgaccaatctatcctacttgagagaatcagcactggcatatggagggaaccatctggaatttctgttgctcaatgggtggctgatgggggagctgatctggaaagaggctccaaaaagaattaatgagttccagatgtaattaaagactgcttttccccccaaaggggctcaggactagccatggggtggtgcctcttggttccgaattacaccctttaaccacttgttcatccatcaagcactaaacaccaccatctttatcctagtgtgttttgccaagcagtgttttggctttttggtctttttttcctgaaagtgttctatttttacaattagaacactaaagctttaaaaataatatctggaaagttaacaataaggagaaacccctgaatttatccctgcaccaaatgcaacaacaacaacaacaaaaaagactcagtgttttattagaaatgcattaactagcctcaagaccagaaaacctgagccagactgaaagacagatgtctctgaaagagggctggggcttcttttgtatcaagaacaatttgactaccacagttacaaagcattccatgtaagttgaacgctagatttaaactcactttttttcccagcaaagtagggaatcaaggtcactattgtgtagcattccaagggtctgacacttgtctaaatcctgtagaaatgagatcaagggcaaagggcacagatcctgggaataatgatggggtcacatgaacaggcataatttagggcaggcagacccactgcttgtatggtatgcactgtatcaggccccataacttaggtggtaagacagtttctattacaaccctgctattgtcaggaaagcagcctgtactgactttggacacagctcagacttctgagggagagcaatggcatgccaggcagagcaggacatacaaggactatttgtgggcttgttattttcctgtaccttccataattaatgggttttttttctacattcagccttggctcctgtgttttctattaaatatgtgaaccaaaggaaaagtaaattttaaagctatttgaatcactattaaatgatctaatcttcctttgtagaaagaaaatatttttagctccaaagtgactgctttaaatatacattttacacaatgattggtgatattttctttcttttgtggtctcgtttaactttggaggcatctaacaatttatttaaatagtctatcataatttataaagatgaatgataacatccaagaaaagtattcctaaaatagaatggaaactcttatacataaatagttcacagagatgaaagatgaacatgattgaaaattagtgtcaagtagactaatttactgagatgatggtattcagttctctagagttcattctcttgtagaaaaagctgaccagagatgtgctagaagataaggatgcagtctttctataactaaactcttttcaaagaagtgctagctttatagtctgcctttttcatcaaatccacacaggtggtttctttattctactctgcccatcattttttttcaaactggtcttaaaaataggcagaagaggcagtttcaaagtgcccagaggcacacgattcaagactaaaagccagtttcctgacaccctgaagaaaaaccatctgctggcctgattgtgtgtgtgtgtgtgagagagagagagagagagagagagagacaggatggaaggggaggagagaaaaatagctcttctcactctcacctcatgagaagagtcccatttaaactttggacaataaatccccatcccactccccacattctttctgtgtctttttcaatcacacacagacatgcataattcccatagtagaataaacattttaaattatgatattttaattgatcaataaaatgtttaacatacaatgtttatttcttcctctagtctataccatctgttcttcagaaatattttgaatctatttaataggaaggtttttaagtaaaattaccaactgtatcagatcagtcctctgcatcccaaattctgaaaggagaataccagaaggtgctgctgttttcataaaaatagaaaagaatctgtgccttctctcatcccaggctttattattattgttttaaatctagagacggtgctatgctactgttctcttcatcagacttcaaagaaatcagagtggacgacatggcattgccatttaaaccaaggtctatagttgtcaccttgctcagatggctcaaggcaaaaacaacaacaacaacaatcaaacaaacaaaaaacctagaccttgcaatccccagaagacctaaaaaggaacaatatgcattttgataaattttaggtctgatgttaaactacagtttggctttatccacataattctattacctgtatacattgttaatgaattctaactaacatgaggtttggagataaaatccctctccaatcctgtagtgaataatgcttaatatgtgaaaaggcataaactggcaactctcaggtgatccaattattaaatttttacatgttacagttggtgttaaagccaaactaagcgccaaacttattttcctatgtgggtttttgttttgatttgtttccttaagaataataacatgatcaacttttagtaaataaatatattttgtacttttaccctgaatagaaaaatatgaatatctatgaaataagtgattcactcctgaacggtgctgtttaggcaaaggtccagatatcaaatattgtatcaaataagtttatttctccccatcaggtcttttttgaaaataaatcttctctttttgtctctgcttgacactagacagggcaatatatccaaaaaactatgagattctttaattttcctcggtattattgactttttttcttaagttctcaattgtttcttctgcaggaaaagaaacccaaaagattattaaaatcttaaaaataagatgcttgtatcctatttgtttgttaaatatacatatattatatcaattataattgatgtttaagagagagtttaaaatgtagtatctgagtaacaaatatttagtaaataatctctactttctattttaatatgttgtaccaaaatttatattttctgagcaaaccaatctatatgttgtgctcctaaattaataaagtgcttatattttataaagtacaaaataacttctgtagaagttgtcattgttctcaatatttttatattttccatattttttggaaagtccccaaaaattaactcccttaaaagtcttcttgtaaattccagtaaattacatgtattcaaagcaaggagttcttgcttggggtttccaaaatatgttattttccacttgaattcgaatattgtcccagagatcatgaaggttcctagaatgtttattcacaattctaactattctaacaataatatctggattctacaacctctatcaaaagtcccaatactctaaaatatccttgcttggtaaacatactgaaatccttgtccttagagttaattcctctttttaatccaagatgactagaagaccccaggagaaaaatgatatataaagaaaaggtattatcactgaccaatacatttgctcattcatccattcattcacttagcaaatactaccaagtgctttgtcagacactgtgatatatgccaaagaaacaaacataaataaaacaaggctcctacttcacatagagaagaaattttttttttgagacagagtttcactcttgtcacccaggctggagtgcaatggtgcgatcttggctcactgtaatctccgccacctgggttcaagcaattctcttgcctcagcttccctagtagctgggattacaggtgcccatcaccacgcctggctaaagttttgtattattagtagagatggggtttcaccatgttggccaggctggtctcaaactcctgacctcaggtgatctgcctgcctcagcctcccaaagtgctgggattacaggtgtgagccaccaggtaatgaaattgatgggatgagttttggaagaacaaagaagtagatgtgaagtccttttagtatttgcttgtgatacccaccaaaatgatcatggcaaagcccaggcaacatttcaaagtaaaaaagactatgtctgtttcttcctactttcgagtgcccatccatctctgataaactactgacctcatttgctcataactaccaaatggccagaatcccactgatgcccaaccaccaacagtccacacagatgaagggtctcagtagttctatagttccagtaatttctcagctgtgtcccaagtccctctaggctcaactcacttatacatgactaagtagagaaatactaattcattggggggggggggggcggtaacaggagaaattaagcgaaatgccacataaaaaattattacagtggctggcacataaaaggcattcaattatcagctattgttttcatatgcccaacatgtagcttggagtacttgctctatacctgtcacttcgctattgtgtgaaccaaagagacacagttcttggcctcatgaaatctaaaattttgtggaggaaataagacattaatacacaattgcaaaacttcataagcacaaactctgcaaattggtaagaagaaaaatacataatactatgagagtaacagtgagggatcaagggtgagacctaaagagtgagcagcagttaactaggtgtagagttgctccagagaaaggaggcaggacagatgaaaagtcagaagcgggaaagagctccatacatccaaaagactgaaaagcgagaaatgcaaatcaaaatcacaatgagataccatctcacaccagtcagaatggctattattaaaaagtcaaaaaataatagatgctgacgaggctgtgaagaaaaaggaatgcttatacactgttggtgggaatccaaattagttcagccactgtggaaaaaagtttggtgatttctcaaagaactaaaaatagaactaccattaaaaccagcaatcaccttactgggtatatatccaaaggaaaataaattattctaccaaaagacacatgcacttgtaggtttatcacagcactgctctcagtagcaaagacatggaatcaacctacctgcccatcaatggtggattggataaagaaactgtggtacacatatgccatggaacactacacagccataaaaaagaataaaatcatgttctttgcagccacatgggtgctgctggaggccattatcttaaacaaattaacacaggaacagaaaactaaatactacatgttctcacttataagtggaggtaagcgttgggtacacatggacatagaaatgaaaataacacactagagactgctagagacggaaagaagggatgaaggcaagggctgaagagctacctattgggtgctatgctcactacctgggtgaaaggattcactcatatcccaaacctcagcgttatgtaatacttacatgtaaccagcctgcacatgtaccatctgaatataaatgaaaagttgaaattatattttttaaaaaagactgaaaagcaacaggaatgcccacattgctgaatctggaggagagaggtaagaggcagggctagaaaggcgggcaagagagcagattaggaagactatgtaaaaacaatgagatttttgtcatgataatgaaagtaagccactaaggggaaatgaaagagggaaattacacagccaactcatatttttcagagtgctctggctgcagtgggggagaatggagtagatgagggtaagcacagcaggagaagaataattaagaggcattctatggctgcatagtattccatggtgtatatgtgccacattttcttaatccagtctatcattgttggacatttggcttggttccaagtctttgctattgtgaatagtgccacaataaacatacgtgtgcatgtgtctgtatagcagcatgatttataatcctttgggtatatacccagtaacaggatggctgggtccagatggtatttctagttctagatccctgaggaattgccacactgatgggaggggggagggataggattaggataggattaggagatatacctaatgttaaatgacgagttaatgggtgcagcacaccaacatggcacatgtatacatatgtaactaacctgcacattgtgcacatgtaccctaaaacttaaagtataataaaaaaaaaagaggcattctagtggttcacccaagaggccatgatgcatatattagggtggtgagagaggaaattaaaaaacacatatctgagtaacattcaagaagcagaatagccaggattggataaagtgtcaagaacaaccctgagcaattgagagtggaagatggtgccatgtgctggaatgggaaagctggaagaagagtaagttggccactggcaatggcaggcttggtagggagagagcaagaatagaggattctctctgagttattttagtttaagataactgtacatcatcccagtgcagatttcaagtggacaattacacatataggtctgatccttgggaaaagacaaaacatatttatgagttcaagaaccatcaatagcttcacaactagaaaatgtatgttctccaaaaatcaccaagacagaatgagaagaatcgttatctaaaaatagatgagggtttttttttaattcaagggagtttttaaaatcatatggagcattcaaaaatgtgtttgctaataggaaatgtcatatagagagggaaagactgcagacaagaaagagaaaggaaggagacaattatggactgagatatctgaaaaggaataacagcattaagatgcagagaacatcaggtgggattatctttgggagaaggtaaaacactttgttacaacaggaggaaagaaagagaagaaaggggtgctgcaatttacatatacttgtctcctttaaagaggagcctgaggatacctaaaataccctgcaaaagactatgaacttgggacacactttcagttcacctctaaatcatatcatgtaaacattagacttcttctgctaataaccaatagaaatcagggatgatctctactataaaactctgtgtgtaaaaatatatctatctggccaggcatggtgactcatgcctgtaatcgaagcactttgggaggccgaggcaggttgatcactgaggtcaggagctcgagactagtctggccaacatggtgaaaccccatctctacttctctactaaaaaaatgaaaaatattagccaggcatggtggctcattcctgtaatcccagatacttgggaggctgaggcaggagaattacttgaacccgggaggcagaggttgcagtgagccgaaatcatgccactacactccagcctgggcaacagagcgagactctgtctcaaaaaaaaaaaaaaaaaaaaaatatatatatatatatatatatgtatatgtgtgtgtgtgtgtgtgtgtgtgtgtgtgtgtgtgtatccatctatatgagcatctggcttaatgtctacttaaaaaactttattaccttaacaccatctgaacaggattcttttaaaagtaactaatgagaattaatacgtaagaatgagtgactgctgtataaatacataaaatagttaatgaaattaatgcacatgcatctagacatccatatatcaagccaagcatgtattttacatatggagtctttgtatccatccattcattctcgaatagagactagttctatattacaacatggatgaaacttgagaacatcatgcagggtgagaaacttcactgtatgattccttttacatgaaatgtctagagtaggaaaatctgtagagatggaaagtagattaatggttgcctgtggctgggggagattgcggactagggagttatagcctaaggggtatggggtttctttggggggtaatcaaatgttccaaaattaattacagtaatcgcatgtctctgtaaaaaccacgaattgtacaatttaaaaggatgaattttatggtatgtgaattatatctcaataaatctcttaaaaattaaagtactttttgtactaatatggaataatcatatctttctatactaatatggaataattacatggaataataatagcttttaaagcaaggcacacatagtgtacaatttgtaatatttatacaaagggagtgaataaaaataaatgtagtgtgtgttttttttaatttttgcatatgcagcacagaatatctttcgaaagataccaaaggaaggaaccagtaacactgccatcttcaggaaatgaaactggctggctggaagacatgggtgaagggaaaattttcaatgagcaatctttttctctttgaattttgaacaaagtaaatacactactttaaaatcttttaaaaaattgaaattaaaattaaaagtagagactagtcataattttatttgaaatgcaaattaaaaaagaatctctcacacacacacacacatttgcatgtgtgtgtgtttatgtatgtgtgtcttttagtccttgtcagacatgtaatttttttctgctgacaggaatataagaaatatgagcaagagaataagctgtgcagacttcttatttgacctggctttgacttcctgtttctaatgtcccttaatttacattttgataggtaatgttcctttctcattttatcttcatatttgcaatttttacatttggatatttatggaatgtggatctacgcaaaatttgactctgccattggaattggagttcagtatgatgtttcaatttattctgacttcagtttttgcttgctaagttaatattaggacaagatcaaactccattaccttgcatagattactctctagaaagttctccctattgccactttgctggtccataatcactggagacaacttcctgaaatatggatttatgggaaggcaaacaaagaattataaacacaaagaaaatcagaaaactatgaaagagatatactgaataatcaataatcaattcaatatcccaagaactaatactcaaagatacaaaataaagcaaatggaaaatttagcttaagcatattcccaaacacactttaaaaacacagaatattttagaagcatacaaaaatagtttcttgtatttccttttgattcctttatatttaatataagactctagttcgtctggcatggcatgacttgggaacacaacagaattttttttagcatgtgggtagacaactattccaacataatttactgaaacgtagtattttcccactgttttgaaatgccatcttaattactaagtacattcttttatatccatgggtctgtttctggactctattttgtctcattcactttcctctcctgcctcttcctatgacaatatcataccagctttatctagaccaatcctccccaaaataatgtttttaaaatccttgccagttgtatatttgcttttcctaaaaatattagaatcagcttctcacgttctaattttttttaatctaaatgcaattttaactaggcttacttgaatttataaatccatgtgggggagaatcttttcatcattgtgtcttcctgtatttgtacagcattccacctatttagcaaggttttcagggggtttttcttcacatgacatatgaattttttgtttatatctaggtattttacctttttccatcaaaagtggaatttattgtctattgcattttctaattagtgattgctattatacaggaatgctattgttccttgcatgctagtattgttgccagccattttacttaaatatcttgtattttttttctagaaaaaaaaaaacataggcttaccagtaattgttttcctgcttctttcaagtggctgtgctttctatcctatttttttcatgtactattgcattgtttggtatctccagtaatagaaataagagtaggcattcacgttttattctcgacactaacaggaatgaaattaacctttcacacttaattataatatttcctatggacttcttgtaaacaccttatatccagttaagagaaattcccctatttctgtaataataaattgttgttgagtattaacagatagaaatttatcaaatgcttttaaaaaaattgatttggggtcttggaaaacaccctacaaaattcactcgatactaccatgtaaacactttttcttctaatgggaagcagatgagtttaacatactgtaattgttaactcttgcccttaaccaagggatacaaataatctatgccacattcaagaggaagacagcatattttctacaccaaaagaaaacaacaacaaaaaacaggaaatgccttcaaaaatcttgttttaaatgtctgcttagatttcagatttctttactttagatgcttctataaaataacagagaaattttaccctcagtatcccaagttttccaagacttgtgattgggaaccataataagcctattaatttctgttttggttcatcttctccttcttcagcccactgataccatccttcactctgccccactgccctagaaatagttttctctgctcactcacccttagccacctaaaatatgtgacacttccccatggccctgatgtgccctggaaccttggacagtctgaatatttaagaagcccttactcagataaagacacagagtagtataggcagaagctggcactgcacgtgacaaggggaagaaagacaataaaacttatttagtcattcttggctctttatatatggaatatcgtgcctcattattataaaaagaaagtacaatcttggggaaacagagagacttctaattttgtcttactgaattatgttagattatttttcctgatattctagaactatccttgcattcctgggattaaaccctatttaactataatttgtgattctttggaagcacaggtacattggatttagtaagacttctcctcaatatcaatgagattagcctttaattttcttctttgtgccacctttatctaattatataatcaatcctatagccttaagaatgaattaggaagatttttatttttctccaggttctgaaagagtttataatatggtgattatgtgttccttgaaggtatgttttgcatttttaaagaagtaacccggatgatctcagctataggtaggctatgaattcactttaagatcaactgacctgaaaaaattctcccacttgaacaatgaggcataaatatttttgtcattgtattgtttataaaagtgaaaaaattggggtgaaaatttatgttcatcagtaagatggtaattcaataaattataccacattcctactctgggtaactacactgtcatttaaaaggatgcaggacatttgtcattactgatatgatagtattttgaatatagacttaacttttttgaaagtcacatatgaatacttagaacatatgcttttcattgctgaattaaggaacatcttagcatggcatataagagttctagagtcaaactattgggtccaaatattgtccctctaccaatcacttttatgatctctatttctcagtttcccggctacctgataaagagagatggtaatagtgcttcacagggtgttgtgaggattccaaagtgaattcatccaaaacgctaaggatagaaactgatatgtagtaaaatactcaattaattaatatttttaaagttattcattatataaataaatacacatatttaaaaaaatgtaatcccaactgagaatagcagttatccaggggagggcaaaaagaaagggctaaatggttcttgatattttgctttgtatatttttacattattttgaacagaaaaaaattatgtattatgtttaaaattttttaaagaacaaagttacagaagcctaatactaattgtaaagatgtcagatagccatatataattagatgtctaagacaagaaaggtattggactttcattcaggtacaaagcaacatggaggccagcatggagagagcagcaggaatgagacacacctggatttacatcccgctcggtccctttgtagctgtgggacccagggaatattacttatcctctaagctagggttttaatagctggtaggtccacagacaccctattagagtttcagtaccatttgcaaagttggttcaaaatatagatcactagtaatttagaaacatttccattgacttttatgcatgctaaagtttaagaaacaaaataaagttaagaaaccaaaataaaatacaataaaaattctaagcctcccaaccaactgaatggatcctcctctcagccaaggggattccaaagaaacctgaaaaattagctcaggccacgatgggaaggagtggtcatcagacatacctcattatacattcctgcctttggaatttaggtacaactgaccagcattaacattaaaacagagatattaaaactgacaaacagactattttggagcaataaggtactaaattccaacccaactctagtagagcatcacatgacagatagcaggtcctgaaagtatcaaagtattttaccgcaaaatatatttgtctgtcatattttgaaatggctatgcaaagctgtctcttatgggggaaatttatattctttagagaatcgcattccatctccaggtcttttttagatcctgaagagattagctgagagtctagtacctttcaaatgtctgaataggaaatgtttgccatctattacctctaagggtagtcacctaaagacttcatcttcataataagaaccttggtatgcacaaccctttatcttaacccagacactcctttctattgattccaggtttttagataataatttaactctttcaaccaattgccaatcagaaaatctttgaatccacctatgacctgtaagcctgcttcccacttcaagttgtcctacctttccagagcaaaccaatgtatacctgacatgcattcattgatgtcttatgtctccctaaaacataaaaaaacaagctgtaacccaaccaccttgagcacaagttctcaggacctcctgaggctgtgtcacaggacatggtcctcatattcagctcaaaataaaactcttcaaatattttgaagagtttgacctttttattaacagaactgctctcaattttgatttcttagtgtgtcaaacatggtgccaatgtcacaccatatttataaagctttagtgagataaaataaatatttaatactgtgcctggaacattaaaaaactgaactcatgttattataataacgggtacattgttgctagtactaccactgttatcaccatactctgtaataactgttcctgtgtttaaatgaaggatctgatatttcctcaacatgccatagccttctatggccttatatttatataacttattactttttctggctcaaaaaataaatgtgaatatctctactatttcctacatttttttttactggtaatattttgtggccttctgattttaacttctgaccactattattcaagtaacctgggatcttgaaaaagtaagtgcagtgcttggaactaaaattctggtatggtccttattaacgcaatatgatttgggcttgactgtgatgggagattgtagaaataggataggaaaagaaaagatatcggaatagtagagcttataagaattgtggttaaagttttcctctctgggtgaggcttgtactaagcatggggtggcaaaaactatgttattaataaaatactatattttctaagaacaaaccagccttccccttctctttgttacctgaaaaacctaggcataaagctacatgagtctttggtcctgattctccatttcctttggagggaaaaaaaaagtccacatttctcacacagctttgagggaaagactcataaccatacttaatgtataaaagctgtgatttccatgcaaactgctgctttcccagaaaaatgtaaaagccccctttagcagtttaaaaatcctttaaccatttccttcctgttccacttgaactaggggccagcttgctgtgccttaaagccttccttcagtggctttcagatgaataagttaattttagaagtgttagaaacatttttaattcattcagacttgcaagatatcattaaataccaggtacatacactaggagccaagaagagttactctacgattctctcagtcacagataatttccttaccatactgggatttaggcctagcactgcaaacagcaaaacttgggcttcctcacagtagccaatgtcatagctctaagcctgcaccaatgtttactcatttacactctttcttttatagtttcaccaaaaaagaaaacaaacaaaaacaggtgcatccacactatacaaatgagaaaaggtaacctctgaaaccatttcacagcaaacagaagatccacaagctgctcactagctaaaaccacaggaggtgtgtcaggcaccttgatgctgagccacaggaggcctgcaggcttggaaggcagtaaatccccagagagctctaaactcctgattggcaagccacaccaggcccatcagctcctcaggtgctgagccacaggaggcctgtcaactgctcaggtggaaggtgtgggaggagggaggaggcaagctgtgtggaggagcttgaatgaaaggccaccggctcaccaggggagacaggaaatgagaggtgcctactgggaatactagagttcagagaacttcatcaagaaaaggaacgaacccaccccctccttgcatcttcttacctgcagggaagcacatctcacagagagtacatttctggcccagggattctaaataaataaatgctaatgtagaatgattcccagattgagttctgcagcagaccaccaggtcttccagagaaaatcagcacctctttgtcagttgctaaggttctcagggaacggccaccctccatccaccctttgtttgccaagattctcagtatgacagtgacacagtgacatctcccccttaagtttccaaaagtcctggaaatactttagtagggactgactagtcagtgactgcatctcactctttcatttatttactctagcatttgttgtggctataagccaaatcctctgctttgcattagagatataaaaagtcaaataagacataacctctgttctcgaggtgacataaaagtaagtaatatttacagaataagggtatatgacagaaatatatccaaggtgttgtaggaacccagcggaaggagaattaaatcaaatgaggattcggggacactttctagaagaggtgccaccaagttgagtgttaaaggacaaaaataaataagctgaaagagaggtttagggtggggagggagagaaagggaaagaaaggagaagtggaaaaagttacaggtagtaagaagagcaagtaaaaataactggaaaagaaatagtcgattccatccaagaagaatgagtagataagtagaactggacaacaatgcatgcaggagaacagcagacgatgaggccagatcacaaagggctctgcagtccaaacaaatacgtttgaaatcgactctgaaagcttcaggaagcccccaagtatcatgcaacatcgatatccaagaccaaggcctcagaaaaattaaagcctgctgattttgaaaattgggtttctcaggtttctgtaaaggttaacttatttccaactaaataagaaaaaaacaagattatttcagattcatagtcagccttagctctggttcctgaagtaaaatttctcactttatattttgccacttggttgttaaatcttttgtgaaaccatatacatatatgatcatgtatagcatatatagcacatattttactaatatgtctttaaaaaaggatgcttgccatagtaaataaacagtaatatgatattaaaactcaagtaagtgccaaatattccttttctggaagggtaaaattttaaccatatattcccaatatgatttactttctcataaatgtattaataaattgctaattacacatatgtagtgcaatactaatgtaataaatattatctacatagtaaaacatagaaaaagaaaattttcaaggaatagaataaaaataaggaaaaataaaggttttgacattttctatttgttcttcagtaagtcatcattcaaacctatgttggaagccccctacttacttagacagctaagacagatctacacccccatgcctctgtgctctgtgcaattgcatgtagatgtctgtacacctttcattaaaccaaatcaactaaaggaagaggaaaagagataaggagagtggtgaggtaacacacctgtggtgggctttgtagccaataagaagctgaggcaatagagctggatgggagaagacacctgttaaatgaagtttagcctgaagctgcctccttacatattttaagtctggcttaaaggcttctctgcatatagttaattgtaacctaactagatatgtaaacagactgtaacctactcttgtgccaatcacagagtttcagccagtcaaaggcgaccaactgatcaaactgtgtgcaaaaaaggcaaatgctaagctgtaaccaatctggccatttctgtacctcattcctattttctgtatatcactttcctttttctgtccataaatcctctgccacatggctgcacgagagcctctttgagcctactgtggctcaggaggctgcccaatttgcaaacggttctttgctcaattaaactctgttaaatttaatttgtcttaaggtttttctttgaaaatacccttccctccactccctggggtcaatgtgagggtgaaggaaaacataaattatgaaccaagctcttgaccctctttgtagtacatgaaaagcaacctggggtgaaggcagggatagatacaggacgttttatccgaggagcaagagagagtcatggggcttccaggatagccttggccccagaagttctttcccatattaccagaactctgggatcttagggacagacttgttttttgaggggttttttttcccatttttctctaggagcatttagaagtcagcaatttgggaaccactctacataaggtatgtgcctctatttccttactacaggtgatcttgctaaatgtaaaccctattcacaaaatgtgtgtcatcataggatcttgcccacttctcttttccgcaggatttagtaagaaaaaaaaatgctattgtggtgaagattggaattatcaatacctcaacctatgggaggaaactctgctgtagacacccatccccctagatttctcaagaagaaggagctgccacacactacttcctgccctatgatatactgaggggagagggaaggggactggtgtgtcagtttcagagttttgattcaggactacagccgtgtccccagagcaaacaccccaaggcattcagcctcactatgccaacagcaatcattcctgctgatccaacacacgttcaccgattatgaatgaatgagagcggctgggatttaatcagcactctattcaatccaccatgcctccatccattcattcactcactcgctcactcctctaacaaataaacaaagaacttctactcttctggagcttccctggacacaggaagcacaaagatgagaaggccccattggtgccaataacattctggaagacagcagagaagtgcctgccatttgcaccccttgctgaccacagcccagacagcctgggcagagtgcagaacattcaccacctccgtgcgtgggctatacagacaccatctctccacacactactgctgcctgaaaaatgcagtcagatgggttgtcattaagcctgacaaaaacccagcaccatctaggtaagagcaatgttttttatccagacactaaattgcaatcaggttacgttatcatgtaaataaagaggcaaacagatggtttcaaacgagatccagggctttcagagcattgccgatgttacaaatgaagaaaagcaaggacaagccattagacacagagcgggccccggagtgcacagcagcccaacaaacagaatcctggcctggataatgcagccaaaacaaaaggcagtcacttactgcttgcaattgtttgttaatcaaataccactaatttccaaatctgggcaaatgctctgagaaacatatattcatactttttccataaaatatattttgcaacggtgtcatctgtgtatatcaccatgacccttaataacacagctttttaaaggctctgttttatttcctcccacatgtttaaataggaacagtgtaatgaactagacagactcagggaatccagaggcctagatttgactctactgtctctgttatctctgagctctttcttgggcatgccctcttgcgatcatttccctcaactgtaaaatgtgaaaacaaaaaatgtggccgaggccattagctgcttcccagtatttattttatcctcccttagtaataagaactccaatttttagctgaatagtttgtcacctagccaaaagactacatttcccagcttcctttccaggtagaagtggccacgtggctaagtttacactattaagatgtaaacagaagtgtcatgtgagaaataaaagaagaatcctttctcctttctgctgcctggaatgcggctgcaatggctggtgctccagcacattgatggaccaccgagtgactttggaaatagaaaaaacactggaggacaaaaaggtagaaggggtccaagtccctgacaccatggaacagatttttatgtaagagagatgtaaactgacatatctatcaacctcgtaccataataacaatttttaataaaaataataattttcagggtttttttattcacagaagacttaatcttcctaatacctggatacccaaacccctaattcttaatacctggacaacaaaactcccagaatggtcgtgagtgttaaattaggtgtgagaactctttgtactcaaaatgtttccctgaatcctcagcatgataagctgctctgtgaataaaagtgttacacgatcaaacatgctggagaacagctggtactatatccccctccgaaagttatacaacccatattgtcatataaaaggatttgaaaagaccagaaacaaaaaaaagtatttatctgtgcttagtccaaaatttttcaaatttgtttgacttacttttttttccatgtgatgcttacagggagctagtttcagaggaaacactttgagaaatcctgggtaaatttcttaccagtaatagctaatatctaaattgttgcttttagccttcaaatatgaattgtaattgaatttacttctatgccagtccaggtccaggtcttacagtatatgctttcattactctctgaatgtttcctatagcacatttgttagtcgtattcatttttaactacatgcaattacatttctatctccccagctaggcagtatgttccaggtgggtctcagaactattttgctcatcattttatctccaacatgaggcaaagtggcacataataagttatgcacccagtaaatagttgctgaataaatgcatgatttctgaactctgttttcatatcacacattatgcaaacagcagtgatggaatacatgtaaatcaattttggctttgcgaggggttttaatctcttttagctctcttggatggcatttggaccattagctccaccagtgcctatgtatatactcttaatgaactgaacgttagaatgtcccttctaagtatcattatttagtaaacataagaaatcctgagtaacattgacctaaaaataaaataggagatttttaacgtacttgcagataaagaaaatatcagaattctcaccaagacccattactgggttcaactggtctggatatccaagatagatcacttacatagctggaagctgagattggctcttggctacagcttatctccatctggggctgccaagcagtgcacaaaaatgacctttccatatgatttagattcccatagcctaaggtatgtgttccaaaaggaaacaccccaatggcaaatgagacttctaggcaaaaggatcttctaatgcaagggttcttgtgacctagccttcaaaatccaagaacattattctattaatacagtctgtcagtccatctagtcacaaaggccagcacagattccaggggagggcaggaagctctatgtccctatagaaggagcagcaagcatttataggaaggaacaaaatttatggtagccctttttggagaatttctgcaataatgacattgaaactacgatacctattagaaccagtgctaggtactgttactcaaccttctaacagaggagcatattatatcacattttattttaatattttgataaccataacaatataactgatttcttttataatcctactttattttatgtatcaaaaaaattatttagagaatgggtctaggctttaccagactgccaaagggatctgggacatataaaatgttaagaacccttgagctgcttaatagtgtggtaacctaagggtcagcaatgagccaactatgccattcctgcccctgctggcctgcctgtacctacaaagaccttgtcacttcagcaaagttcttatctctaaacctctgtacatgaggaaactccaaaagctccctcaagggagtataatcaactcaagaaatggcaactgtacctaaaccaatgattgggaaatcatgaattatttaattttacattccaaaaatatctgcatggaaaacagaccataaagagaaaaaaagtaattcaatgagaacacgtgaaaaaagccctgctctgcattaaaaactcccacgggcagctgctccttgcttggcttgtacttcccaaccccaaccaggggggtaaaatacatatgcaatcactcagtttcccttcttttgtaagaaaggccttggtaacactcctcaaagaatattaattccatgagacaaagttcttagggcaataaaactaggtaaaatatgtttatgcattttaatcaggggaaatttttattaaccctcagcaaacttgttgcagtgcaaatcatagaatatggggttggcacaaactttaatggtgatttcttagtagggtgacccaatcattctggtttgcctcagacttcccaggttttatcactgaaagtcctatgtcccaggaaacaccctcagtcctggataaaccagggtagcaggtcattctctttaccaatgattttaaagacattagttcctgatatttatgtctccaaataaatattaaaacctatggatgccactgtcggtattccagaactgaaaggaattaaccaattagctctgatagagtaatgttgcctgttttaaataacatggacttcaattcttacctccaggattgaactcattctaagagttatacataatctcctaaattttaaaacaaaatatattttgtattgtgttgtgtttttgtaatactctacttttaggaaatgacagggattcagtgatttcattttttgtttgtttgtttgtttgttttttgagacggagtctcgctctgtcacccaggctgaagcgctccacctcctgggttcaagtgattctcatgcctcagcctcccaagtagctgggattacaggcgcacaccaccacaccaggctaatttttgtatttttagtagagacagggtttcaccatgttggccaggctggtctcaaactcctgacctcaagtgatccgcctgcctcggactcccaaagtgctgggattacaggcgtgagccactccacctggctgacagtaattccttaaatgacataacctattctattttccaaatcaagctgattgagctatacacattaaccagtttggtgggactgagcctattacctgagcctattaatttagaacaccgggcagtactgtaaccagaaagtgaccagggacacaacctggctgccaccttaaaagtctgctcatgggcagtaatggtttttaattttaacaaagatatgggtatccttgaagacaccgatacaatccagatgtgtgaaactataaaacaagcaagagatgttacattagattttgcatttaattagtgggagcctgcacagaggatatagtttattctcaagcaatttccaaattaccatcctccttgtcctccttggaaaatttactgttaaccacctccatcatcgtggtattgctcctttcctgccttgccttctgctgtcctggttctaatttcatgactactcgttctatgatatctcttcctgaaacttaaattagcattgccctaagatgctgacttctacccaatccttatatctctctgcaatagctctcatatgagtcctaacccccattcaatactcaaggcttccttagtcaattcttctgagaattaccaaattgcaatccagattctcaattggccttcctttcaatcttctggtccacatttcccgttaccatctaggcatctgcacatgaacctgagtatatgactataatggaatttattatcctccctgctaaacctactcctttacatgcatcctctatttctattgatggtacccctaggcattcacctgtgtgcaaaagttctggtcatcttctcagctcatttttctttatttttttacaatcgataaattgttaaccctatcaattctgctttcccatcaagtttatggtacttattatatttttccatagcagccatcattgcatttactgctactatatagcttgtaatttgtattgttaaggtcaaagtatacttgaaatcctggggaaagtaatgcatagtttctttaagaaatagttgtaaactgctgctgaaagtttgtacaggttaagtaagagaaagaagttgctatagtagcaaaaaaaaaaaaaaattatacctattgcaactaaaggaaagcatcataggtgttttacaggaatacctgctagaatcctctcaggctacaacagaaggtgcccaatacggtcacacctctgggagactgaggtggagtatttgaaatcataaaagtagttattctctagatgggagcacataccaaaataaaacccgagtctcttatatacttcatgcttgccaattaccgccaccccatgatctttacatcctggggacgtgtgcccctcctagaaaattactatgatccatgatgctaatgctaatggaccatgacaatgagtgtgtttctcaggtgagtgaaaacaagaaaaggtttgtaaaagtcctctattagagtaaaactcgaattagttccagcaagttagcaagccataaagagtgtcaaggcctacctgactttggatcccaagagtagaccctaagtgagttctaattagccagaaacaaatgccatgactgattcaagcagacatggacaaattaagattggaaaaagaatctcaacctatttcaatatatttatatttttatgtttattctgtcacagggaaaaatgcactgctattttaatcgaaatttcatttttatgaagaaaagcatatatagttgagggaaaaattctttttaattcccactcctaattgtccaccctggcaaaagcactgtgtcacagatcttggttagaaagtttaggggactgctgctactcatttgggagcatccgtttgaatcgtggtcattgcaactagaaggaactccctagcctcaaagtgttttgtctcaaaattcaatcctattttaggaacaaaacaaataaatcaatagtagtccctttaataaattttaggggtcaacttaaaacactgggttgaagcatggggactaaaatttcactcagctttggtataaaacatcatataagtttgggcaataatcttaacatatgtcatagcattttacaatttataaaacacattattatttagattattattagttggattagaaagccactacatttcctgccaaatcaacaattctatgtgtctataatttacatatatattaatatttataagtaaatccacctcaaaagaaaacaaataaattactaggtaatcagttcatcaagggactccatatagcaaagcactttatacttagactgctttaaattgtaagtttctatagtatatttttaaatgatttgatatatgaaaagtttatttacattcatcatttcaaagataaactgcttggggatgttggtgagaacacctgctctgtggagtctgaaattcttccttccagtggtgaggacacgactttgacatccttaaagcaaggttcactaaggtctatgattctctctaagaaattgcctaaaaggaaggagaaatagacagtttccaaagatcctttcatctttgacttcaggttttctttttatttatttttattggaaaataatgttgattaaagtttttaggtcaaaagtagcttaaagaacagcttttccattcactttctaaagaaggtcaaaggaaagttcaactgttgtctccctggatctttaatgtctaccctgaaagaaaatgctcgaaatatgtttccttcatgtctttcctcatcccaccatatccctctcttctaagaagaggctctggtcacacatgtaaagatttgaccacaagttgcagttcaacaactaccgtccattcccactgcaaagtgagcaattccaaattgggggcccaattatgtttggagagttgacaaataccactttcaggcagagaagaggtggtgtaattaacactaagcattataggtaaaaataaaataaaataaagaaactaaaaccctttgaatagtctgtctcctggtgttctgtaatttcttattcatgcaagccaacagagtctaaataaagtctgtccagacagggaagacagcacaaatttagcaggctctaaagcactttttgaattaagtcaggtacatctgcttttaattacatacatgcatatatgcttacacacataaacacatacacagaggtagattaaagacagctgcaaattcttagctattcctcctattgagaggtggaacctaattcttctctcctaaatctaggctgacctcaggaccttgcttgaccaagaagttgatggccatgatattctgagcttgccagagccagcttagaaggcatgtggcttccacacaggtctcttggaccacttacttttggaacacctttcttaggctattctttcttggaatccagccatcatgctgtgaggaagcccaagcagccccataataaacccatgaggagaggaactgaggcctcttagttgattatcctaagctcccagccaataaccagcatcaaggcccagccatatgaatgacccatcttaaaggcatctaaaggcagccaaggtgagcctttcaatgaccacagtccagccactatctaactataatgcatggaagaacccaaattagaacacctcggcctcgcctttccccataaaattgtaagcaaaataaaatgtgtgttttatgctgttaggtttctgggtggtttgccaggtaatgatacagtttcagaacacccactccacttgtcaccattctgatgccacacattacaaaaaggaccccagtagctgaagcccaaatttcttcccttcccacttgctaatccagaataagtggggtggtgggctttactgcttttatgtcccatccaaaaggtacaagaccaaaatttgagaactacacaagctatagaaacatcaccaatatttgtttggtttctaattggtgttgtagacctacatctctgctataattcagtatgaaatactgaattacatataatctcagataagaaaaaggtgaatgaagtcaatagttttataatcacaagatttcatagaattcctcccctcaaaaattactttctgatttatgatcatcttgcttcatatcaccaacctattatgatcttttgcaatttaacaaggaggtgcattacatattgccatctttgaacatcacacgactttgataagcttctctggcatttaaggtactgaatattaaaaatcagaacaaacagaagagctattataaaagaaaaacagtactctcccattcatgtcttcaaataaggacagttcaaagtaatatacaaaatgtaacagtgaattctaccacacacataaacacacaaagatgctggaggctacatgatatcatatttgcacccttcaaaacagaatcctgagaaagcactggaggcatcttacacaaatccactctggtcagtttagaacaaggcatagagcagaagctagagggatcttttgccatttgaccagctattctttatgaaggtttgagatttgcgtagtaaggcagaacttgttcctactacttaagaagttgagaatgcattcaggccaatttttccaatatttagaaagcaaagacagtcagatacacttacttgttgaagcaaagttatcacgaacttaaactacaagagcaaattcttaatgattacctcagcttactccatataataccacagagaagaatttacagttctttcaaaatccaatgtccataaagatagaacgccttgaaggaaaatggtaccatacttaagatagtgatgtcttttattagtacagtaaagtcctatttttatggaataggatgggtctgaggtcattccataaaattgatttcccagaaaatggaaataggcaatttaccctaagaattttattgaaaaattatgctattctatttgaataatgatgggaatgttctacacgtttcctttattaatgaattaaaatacacaaaacaccataaaattatattagaggttcaaaagtatcacttaaatcttttttaccagtcactttcattttgtaaaatcagcagttccattaaaatcgtattatgtaaaaatgggtttttactgtaataatagttattacctatttagctcccaaggatgttgtgaaaattaaataataagccattggaaagcaaatacaaagtgttgctaataccagaggccaagaggggcagccagatggaaaaatgaaggaaaagagcacctgatacattacaaatcacagctttcatctgtaattccattaccgccaaaactctatgcgttggtcatgtgcactgatgttatctcatttcatctttcttaacattatattaattatagccctaatgttataaataaaggtcagaaaggtttacagcttgtccaatgtcacaccgttgtaaatgtcagaagccaaatgtgaaccccaggtttatcctagtcgacagctcatcctatatcctgaaggatccccaatatacccttgtgtctcataactgcccctctaattcttacctcatctttcaaaattcacttcaaatgcctcttcttccatgaagccacctttaccctagagacactatgattctaaacacattcagtatttattatggctatttgttgtattattgtgcattatgtgttttattaacccagcaaaatccctggctggtcacagttgtatggaacttgactttgggttcccagatcatgagcgcttggaactgtgccttgaacagagtgaatgtttggtaaatatttgctaaactgaactggaaaggggtgttcatttgaattacaactacatctgctaccagatgcaaagcaaatgcttttactaatggttcattgcattagaatggttctaatgcaatggttcattgcattgcatacctctttgggaagtatctccagtttttccaagcatgtgtgataagattaaatacctcaagcagtgtatctgacatacaggagatactcaacaaataatagttttttattttatttttgttttatttcaagttaagaatgcggatggtaagagaagaatgtggaggggcataaattcagtataatatatagtctaatttggagatatcagagcaggtattgatggtaagtttttttgaaaaaagaaagatacaatgaagagttagaactcttgatttaaattctctgatttcctgcaaagcttctttacttactggctgggtaaaacttgagcaagttaccctctctgcatcccagatttttcatctgtaaaaacagggataataacagaatccacttatagagtggtagtgagaattatatgaaaaaaaaatccttgtaaaatacttagtatggtgcatgtcacacaccaagcactcaagttatagttgctactatcaccatcattactatcatcgtaaaaatcatttcataattcttaggaatctattcaaaggagaagacatttttttccacagactgtaaaatcctatagtggtatgtgtcaatgctgtcaaacacaaagatttatttctgctattgaattatggatgggagcaatgagttcatgcacttcatccaaatgatgcttactgaacgtctactttgcgccagagtcaggtggacaaatttatttgatttaaagaaggctaggaatgaaagaaacaaggggagccaggaaaaggtggagagttcagagagagacaaaaccacaagcagaaaacaaaggtagattcaatccagagacccatcagaggtcaaaatatcagcctgtcaaaaatcagaagggaagagtaaggccaagcagctcctgcataagaccccaatccaaatggcacaatgaattcaatcgctcatcaatcacagatcattttttggagatagaagaggggttattagacaacaggagagggacaatgagcaaggattttattttttatatattacacacctgtttttcactcacctgtcttttcatgtgaaggctagaaataatgaaaaataactgtgtatgttttaaaattcttaacttttctgattatcacaataacactgaaaggccaactggaaagtcctttctacatccaatgcctgtgccccacctcctttcccccacccagcattgatttgtgctatttaagagcagcttcacggagaattcaggcccatcctatgatcttatgagctgaccatagacaaaggaatgaagaatagtggagaaagccagggatcccgggacccaggacacacagtggacacagtcaactgcagtgccaagcaaaatggccaagattgctccttgctcggcataaaaaccccaaaggatactaaaagcttggcaaccttcaaaagcttctcttgcttcctgcatggggtgggggaagcagcttgcttagtgggaaaaaccatagcccagggtgaatccgctggctagattcatcaaagagatggctgagacagaacagatttttccttttcatataggaatgactcacgagcttgtttattcaaaaagttacatcctccatcaaagagaggtggtttactgggaagtgggatgataataataattgacgtttgtactggtcagcccactcacacctgtccctcgtgtctctgggcacagttacacaaacacaccaccaatgataagaaggtggccagtatatcttctttcattcttccttcattctgccacacaaataaagcaaacaatacagtgaccctcctttattttactcgtagtcattttagaaagggaatgtgcgttattggttcaagatgaggactggaagaaagactgcttgggttcaaattttgactctgcaaattgcaaaccgtgggaccctgaacaagtgacttaattgtcctgggcctctgtttctctgtctgtaaaagtggggataataatattacttatttcataaggttattgtgaggattaaattagttggtacatggaaaacagttcccggcacattgttagttctcagtaaatgtttgacattatcattattattacttcacagatggttaaatgttcttccattatggatcttcttttattcactattatcttaagaggttcaaattaaaccataaatgtaattaggtctttgggggaaaatataattgtcctatgaaaaacattttcttctcaggctagggagatattctggaacttttgaaaactctcctttaaataagaagattttataagtatggctgtgtgtttctgtatatctaaggaatcatcttttttataacgtgtatactggaagataggtctagacaaacagatgaatagatacatagataggtatttttctattttattaacctacttctcggcaattttcaaaactcatagcaaccgaagagcttgtcatttttcctcagtcctgtatttcaaaattcccaaaggcaaaccatcagaatgcattaataaattgttgtcttccataccctctgtgtctttcaaacttaaggatactagaacctgtaaatccattctctgacacatgaagaaaattaaccagttagtggattattttaactcctttcagcatgacaattacttattccacttttaatgaagatatgctaggttaattttggggggatttcactggtctatgaaattgttctcctacattaacccccccaaaaagaggaagaatgaaacaacataagtgcctacttatttccaaactctttactgtgttgtacaatataaatgaaacataatcagatctggctgggttcagcctgtctgtgattcatctcttgggtagttttactcactgggtaaaatgagaacgtcatccccagggcctggaatggtattgttgtatcctccccagccttcttcaacaccttgccatgtttcagggagggaccattttaaagctgattcaggggcagaggtagaagctagaaaataaaaaaaaattttgaaaatctaatccattgtgataacttccaaattctatccttattttaggatgctagtggtattttcacctcccaaagaagctgcctatcaatattttataagtttctgtacaaatatttatcagttaaaaagcaagtaattattcaatccttagattaccttcacttctgaaaaaaatcccacttttgttattatacatctgttttgccttataataaatatggcatgcttatcatgaaatatttaaaaaatgcaaataagaaaggtaataattgcccataatctcactaccttgcaataactaccttttatttctgtttccttccagaatttctcagaatttttacataattgagattatatcaaatcctgttcttattttttacacccagttctacttttgcttagcttagcctattttcctatgcattttataatattatttaaatgccttgtaaacataattttagtggctacatatcatattttaaaaatccataattaattcctaatgtctgacattgagactctttctattctctgttaaattgtaaataatgcagtgttaactgtctctatgcaaatttctcaataaccctgattatcttcttcaaatacattcctcaatggaatgactgagtcaaaggtgatgttcttcccacagctctccctacacattaaaggcggggtaataatctaaaaacttctcagggtggtaacttacagacagatcataccttccaaccagtttctattgattctgcctttgatcgtcaaacggcattttcttttcaaccattctgctagtatctcatcgcataattgaaatgtaaatctaataatttccaatggggactgtccaatagcacatcacgcacaacaccatgctgaaccatatctacttgttctttcctgggatgtgattactggtacagagttagaagggaagagagattgtctcaaaagggtagaatgaaaaggcctcctcttttgaggggagggagggaatcatgtccatgatttgctaattttacaacataaatagtgagcaccttctctattagaactgcccttaaaaagtagggatacaaaaagaaataacatgtcacccttgcctccaaggagctgatagtgttatatcagtattaggaggataaaaactctacacaggcactgaggggagttctttttaatggtacctgatcacgaaaggaagcaagattttgccaggagaagcttcccgagggaagtagtaactcagctgcattttaaagccttagaagttattcaggtaaaggggaggttgtgatgagtgtatgacaagagggttgcactgcagacagaaggatgagcatgagccgaggcaaaaattgggaagtcaagtggaggaatgataagaaatttggtgttgctgaaccacagagctagaagagaggtaagtgacaaggttggtaaaataaacagaggccagagtatgaaagataataaaggtggagggtccagagacttccagcacattaagacagaagtggatgaatagtttgtgccatagggcattcagggtatctctgtggtctccagatggagctatacagcaagcagtggaaaaatatgaattggaaagatgggaagagctctgagcccagagatgaatttggcatcatcggcctagaagctgtatttgaaactctgagggtggttgtaatagctccagaggatttcaaggtgacaagggaaaatacctgatatcagaaacatgaggaacacttagttattttttctaccagacccaattcctcagtagtcatggtttaattagagacccaggataacctaaaagtatatagattgtggtcaagcaaaaaccataggcaacttaattagtacaaaatataccacacaccttgggaataaggcaatgtcttggaataagcatcactcagtaagaggctttataaatatttcataaactccaatactgtaatacctttctaagttttttcccaatgttgcctgcttcccaacattagacccaaaatactcagctgggggtagagtaaggggtatttgtcagggtgacccctagcttgccccacaaagtccagataaaatgtctctgatgcctcatttccagtgatatttcaaacaagcaatgattgttctctaaaacctcacgccaagcttcaggaatctttagttactccaattttatatcacagatgatggaaacaaacattctgtacttttttcacctttactcttgcttataagagggctgacacagtctttagttggacaaattaggccttaaggtagctattctaatgaaggaatgttattatgtacaaatttaattattctataccatcctgcttaagataagaacactaagggataagaaaacatgtttcagtctcctgtcagagttatcagatttctatacaactaatatcagggttctatatgactattattgacaatcaaatttgtggagagaaaaagaagcctacaagagttaaagaagcagcagtcagagatctactgggagaatcagaagagaggaaggtcttggaatcctaagtaatacagcatctccagagagcacaagtgaccttgttaatagtagagttctggtaagagagagaattagaagtcactgttaaacttagcaatcaaggcatgggtgatccagatgacagtggtcccagttgagtggttgagacagaaaccatattacagtggattgaggaatgcactggaggtaaggaaggaaagatgttgggtcagaccatccaaaaagctcactgaggaatggacagtcttaagagttgagaaccacagcctttgatctgtcttctgaagctttagataaattagactagtttcaaaactggagcccatgaattttggtctggaccaacactcctgatgaggcctctccttgcttccctgtacaaatttgtccctcaacaagcacttaagattttaggtagtctcaagtctaatacatgagccaaatgttggcctccacacctttgctcttcatcaacccaggttttcatggctctgcatgaagaggaggctaggcttttgagaagtttgcaggacagctgtctgctaaaggaaaattcagtatccacaaatttgttttgtttttaaatgggaggcactgaacagaagaagccagtaaggaaagaaaggttaactacacgagacaatgagttgttcgctgatgggggaaagtgtggaagatgcaggaagggatgagttaactttgaacaagactagggctgcctgattctcagagatcaaagaaagcgacaaaaacttaggtctgtgggaaaatttaggaaaagaatacccgatgatctggatgttcttatatgaccatggacaatatgtgcacttagtacgggtacatattacatactcatatcggttaacacatagatagatggttaactcattcaaacattggattgacccattcaaacaatggaatgaatgagttaacacagatagatgtgttaactcattcattcattcattcttagttttggcaaaaacgatattgcaataattttactgttttacgtagagctactcattaaacaaaatacattaccatatttaaattttggcactagcacagatactacatacatgagaatcaggcaatgtcttgaaagtatgttatttaaaatttcctcctgatgaaggatattgtactaaatctgtaactctttgtgttttgaaatagttttctgttcccaactatatgaggtaggaaaactggctagattttaatataactcataaattaatctatgctcaataaggcaatttaaacacattagaggctacattgtatagcacaaggaacactgggctgagttgagacatctgagttcctatctaggctcatatgactgactactgatatgactaagtttaatatctgggcttcacatccccatttgtaaaatgaggcaactggataggatagcctgcaaggtctccacctttgttaaaacccacaactctatgaagtatgggctttctatttctcagcagttgtaattgacagttgtaatgcaagcatctccagttaaactgaccccttctaaaaagctctgaatgttccttccagagaatccttagtacagaaatcatcatactacatgctgagtgacatgccaccctgactacagatggttgaaccaagaatggccattcatagatggtccagtatccacagaagggggcctggcatgagagcttccccaacaggtgtgtcctctacagaataggcactgacacagcaaatcaaatctctccttggagaatttgaacatagaaactttcaaagaagagaaaactatccttttccttataacagtaatttttaaacaactgtattaattgattacttagtagtttgactgacatccccaagagatcataagaccccataaagtcaaagttcattccatcttgctcatcatggtatcccccacaccttgcataaaaggcactcaataaacaaggcattttgaaccacctaaaggcaaagagagatgaaggacaaggaacataaaaaacaaagtgtggtggcagctcagaaaacattctgaaaacaatcttgaatcacattcttcatagtccaataagcatggagtagtaaccttcaggattatcatttatagttttagtccagtcctcttacctcatttacctattaatttaaacagaggaattagatcattttctgattagcatgggctctgctctgacatagcacaaaaatgccactgaaaattaaaagaaatctctgcgtttgaaaagatttattcctcttgcaaatgtatagttaaattgactcagaataaacaaaaacaaacaatgaaatacatcagaaggtgcttaggagacatttagtttttgagaatttggctttttgagttagaaagatttcatagaaccatctgacttttgaggagggtttgtttaccctgatttcctgaaattaccaggaacaattaaagtttagagataccctgaatttttctttccatttggagggggcctaatagcccatctgcagatctggagtcctatgtgcacatatggtccataatttatgaaatgtgcttatttacatgtttcaattcttactttcattgctttgaaaaataaatccacctttatatccttttttgacatgcagatacatattttagttacagggcaacacaatagagagttatcagacatataagctttaggactgatacctgcctgtttattaacagtatgacaaggtggaatttgtagaactactggaggacattctgccatactagacacttctacttcgtgtgttaatactcacctgaaatagttgggggcataccttccttcacccggagaatgacttgaacttggccttcacctgaaactaaataccaaaagccacaacttgcatgtgatacaaagatcatcttaatattaaagacagtcacacgtgagaaaagaagaatttatgctaaattctagttgcctaaattttcaaaacagaaaaatgaaatccttgttagttaatctaacaattgatttccaacatttgattttgattgctttcatttgattaaatgtaattgcaatgaggtctccaggagaactggcacataaataattaggagaaacaaaaacagaaacgaaacctttagccatatgttctaaggaagccaatggtgtccagcagggcatatacctcatatcctattttctcttcatcattttgtaggctcagcttttagaattcatgtgtttttcaccaatagagttcagatcatccatgaaatgtatttggttacctttatccaaacaaattgtccttttaatgaagccttttccccaccccctatcctcctcctatcatccaagccaactgagcacatttaaaaggcctggggttcattaattttaagcgttcaataaattagtggaaataatcaaaaggcctgattctttctgataatgacaatttgatgtcaggataaaccagtagattaagctgggaacatatgctcctttgccaagagaggctgctataattaaatagtgaatgcatctacaaggtgctctcacgcctgattaattagtaatcaggtgcacaaactccatttttcagtcacaccttgtctcttattggttaattacctttctgccttattgtttgtcacatgagccacaccttccaccactggagcaccccttgttgctgaaggctgcagccttggggactcggccaaattcacattctccacttttgttttcctggaaccctaaaccctttcctccatcagatgaaataaacacaggatcattctttctaaatataaaacataagcagccaggcgctgtggctcatgcctgtaatcccagcactttgggaggctgaggtgggtggatcacttgaggtcaggagttcaagaccagcctggccaacatggtaaaacccatctctactaaaaacacaaaaactagccatgcgtactggtgcactcctataatcccagctactagggaagctgaggcaggagaattgcttgaaccctgcagtgtggaggttgcagtgagccaagatcacgccactgcactccagcctgggtgacagagcaagactctgtcttgaaaaaactaaaaaatgaaaaataaaaataaaatataagcctcagaatattacaaagaaaatgatccccaaagagatccatgatgagacctcttcaatttctctaatcttattttggtcattttctctttttaaaatttttctaaggatgtaaagcatgagtttgtgtctttctccttacactgccacatgttgagacctggtacaatgacaacatgctcttgacatgttctacctttatcaccacttccaagactttgcttaaattgttccttcaccctgttgcttatttcatgcatctttctaacttaatactaataataaagccaccagtcaaggtgtcatttcctttttttaaaataaggtctaactcatccacttctgttcacgttgatttgtgcattctctaaagttctaaagtacttctaaatccatcctgtgatattcatcccaaacttgttctcaatttaataaatatttattaagcaccaactgataatttaagatttcatcaataattagctttgtcttcaaatttttgagagagagatttttctcatgcaccttatgagaccagatattgctagaaatgtagatacttcattttcatgggccaatttagaaatcctaggtttaatcttgtatctgtagctctttccactacactgcaccaatggcttctggactgagtggtgaatgattttcttaaacctctacacacgcacaaatggtccctacctccaggagaactccctaccaaaacagacattgcaaaactaaaaaatatattgaaaatctgttgctcacttcattaacgttgagtgtgtgaatgccagtcagtgaagagaagtagtttcaggatcagaacagatacagaaaagttaacaaaagcaggaaaaattagaagtctgatttcctataccaccatctacatgcatctgggggcagatgagtatgagacagagggctatctcttcccaaacaccatttcctggtcatggtcatgacaatagtgaatggtgggaagaatgtgggtgctggagcccaacagcctgaatctgaatcctggctcttctggttcctagacatgggccactgacaagttatttgccatttctaaaccttattcatttcatctaaaagtgggaataatcatactatctatctcatatggctattagaaagaaaagatagaatagtccatggaacatgcttagcacagtgcctggcacatcatgaacaataaatgttaactattatcaatactgtcattatggcatgttcatgattccaggtgccagtcaacaaggttcaagaaacatgcttttactttctactctttttacagctgtatctaatcatgatgagctgtagtattacagagttgtaagcaacttaaccagatctgctaaagtttgttaagtgtgttgactctacaaagaactgtaaatgtgaagtgtcatttccaatttgaataaatacaaagagggatgaaaatcatttgagaatgaaggtattgacttgggaagagtttaaaagccttacacaagctgtgatattgtacatatgttttctcagtgcttatgatttctgattttgtatttgtaatatgagaatggttaatcttccgtgtttataaatggagccccattgtagttgatccttcccagattgtaagaagatctgatgctcaaaaagacaaaaaaaaagtctttgggccaattattgccaactttttctgacgagtgctatgtgatctaaacttgctataaacacagacatctagggtgaagaggaaatgtgctaagaaaatggctcctggtaagagaaaagagagttactaaagtagatgtgatacgaggtcctaccaggttaatgtgttgtgtctgaagaactctatcctcacttaaggctctaggaaacagaaaaattaattaattctctccctaaccaggtctaattctctcttgaaattttagagggagaaataagcacccatttatttaaaaataaaaaacacatggaatcttagtaggttatagactccttccctatttcactctttcattcatattctcattctcactttgtcgttttagtttatgcacatattaggacctctcactcaggccacatttatctagtgtgtcagccactgactaaacagtgaaagaacataaaacagcaactgcaatcagtgtctgcaaatgtcatgcagtcccaccctgactcatgacttctctttccgtctctgcctgccctggacccaagccccagctctgtcttcttgtgctggctgttggctctctctgcatttttacctcttacctccacaacctctctgttacctcctctgttgcctccacatcttttccctgtcctgactcacaaatctgtacactccttctattcctcctgtcctgctcagtgaatttgacctcattcctcagaagctgacctctttggcttagccacagagaaggcttgcttgtcagttagtccttggcagctaaagcttgatttacaggaccacactcctgtctgattccagcctcagaggcagccacggaaggcatcttggccctcataaaacatgatcctttaaaggcgttcacagaaatagtatatgaaaatcctgtgattacctttgagtcttctattatccctgtatcattcacttatgaaacagtgaattttgggggggacaaaaggaaaagaacttgatcaagacaccaacacatatatctgcattagccacaatcctgaaagttagctcaattaaaccttcttaattaactcagagaagaataacaattgttattctgactcagagcaatgtttttcatacttctgtggaggtatttgtgatttcccagaccctgccacagacctacacagcctgaatctctcaggagggtcctgggaataagcatttcagctgtttacacaggaggcaaaaaaacacaaatgtaaggaactaaacaaattttctcatactacactcttaaaatattgtttgttctcaggagcaggtgttcttaccaagtaaagagcgagacccagatggaaaagatccttacttcacaattcgtactttttatcaattataccaaacccttacagaccaaatcatattcccaagatgttaaatgcacaatggttactttagaggcataaaaagtttcattttagtatctatacattgtaaagtattttagaaaaaaacaactaacccattaaacccatgatttcatggatattattaagaaaagttaggttttaaaaataagacagtgtagaaattgatttaagaaaaatattaagtaaataatcagacaagaggtataaggatatgacacaattatgaaaatggtactaaaatatctaaagttcaggaagcacagtgttaactaagtattgttttttcttataaattgaaagaagaagagttggtttaaaaggttaggtatataagctcagatttaaaaaaagaaaagatggtatactagaaaaagcactgaacctagagtcagaaaagctatttgaatactggttgcaccacctatgacctgtgtgaattaaggctagcaactcagcattgcggagcattaactccttaacctgagtgattcctaaaagatgtatttgattctaagtttccttccctttcctttctcctcctctcctcttctctcctctcctctcctttccttccttttctccttctcttcctgccttttccttttggagttgtttccaaccaagaggcaaaatcccttttcacatccccagcctctgttctgttatctatatttttgccataaaggttagtgcagttccctgaagtcaattctctacatactggtaaaaatccttggggatctttgggaatgagtttttcataagaatgtaaattaatttattaactagaatgctgtggattgccttagaggggctcagcatgggaatggctgcagagttgcaaaaagattctgattccgctctgcctacaaaatcttccccaagaggtcacaggagccagctgacgccactctcctccttagatcctaaaggaattattttccaggatttgcaggcagtcttctaggccagctgaagaagagaagatttatgcaagcagcctgcttggctccagggcccttgttgcattgaggaaaggaaacctgggcagtggtagacaggatcaggagcctaggctccaacccaggaaagcactcctgattttttaggctctcccaaattaacagcatcttttctgacccatctttgtgatgagacagacctgagttcttctaggcaacttggcacacacaataaagtccatctgcctttccatgcacagccctcttgccctttattcgtggtgaggcggacatttggacacaagtgttggccagcctggctagacatgtcctttttttctcagtcagatcagaaggtggtggtgcagcaggagcctcagccttacaggcagaccttctcagctgccgcctcacacaatgtcccagctcggctgcatctctgctccatgagtgggggctgtgtgaactcgggagggcaactgtgaatggcacagcatctgatatgaatttatcaccggctgctggtcgggagggggatcaagctaggggaaggggctgtgtttaatgcaccctgccacaacccaacagtttgccctaaagagccttttaccaatataaaaggacagggtcaaaagtaagttgacccctgacagaatgtacaattattagaagaaggctgtgtgcgagcagctgctggaaccccactgactctgcatcgggcttccaagagtcagattatgaataatcaactcaagattgttttctccacccttctcaacctccccccgcctccctccaatcttctcctcctgttttgggcaagtcctattctatttctacaggaagaagcatagccctccctagcagctgcaataattgtgttcctattgtgatgaagacctcctcctggccacccccctacaagtggccattgtgagtggaaagtcagtgattatacgctccctctgatgctttgggggacccagctgcctaagtgctgacacaggagtgtgcagaaggccagggagggggctggtggaggtggaggcaagaggtgggggaaacccacgtctgtgagactggactctgacataccagaccttttgcataagtcaagccaagaacaaatgaggcattatcaggccccagtgttgagaggtctcatctccctttgaagtggagctgagcgtggggccaagcagcttttcctcctttggaccaagcaaacatccttcttttgatatgctacatgctcattatctctgccccatttaatgatttttgattgaagggtggcggctgggatgccgagaggatcgttagagaggctccatacagccaagcccataagaaaggctttccttgtgcctgggcctaaatttggaatttcttaacagtgtgcgcttgttcttagaggcagataaaggctgagcgtgaaattcttaattaagcaataaatagagagtggggtgtcagcagatgtagccagtagccatggcaacaggaatcacatgggcaagagagctgagactcgatgtaggcctcaggcctgggcctgactgacagctgaagaatcctacaaagcttgtaaaccagattaattagctgactaattatttcatagcgttaatgtaactaaaaaataaaaatagttcaccatgaactgaaacatccttggaaaaaaacagcagggaaagaggcagtgggaaactggctctgtaaggcaaagacatgagcagtcagggcatcaaatcgcatgaagggaaaaatgggcttgctggatttttctcccaactttgcaaatataaaagaacacttgttctacagtcatacccattcccaagcacggcatagaagctacagttgggatacacgataatagttcatcgtattcataattgtttatcacatcaaatattgctcctgcagcatcctaacacaaacaatagtgcacacaaggttcttcacttgtggtctgtttcataagtagctccttgggcaaaattctcagcagctttagaaaggcaacatgaaccaatctccctaacagatctttttaaatgagtgaggttatcttattctgtggctaacaattgcttaagtggcatcacatttcaatcacgggaacaatatatcatatatgtcatattatggtgaatcccatttatctcacaaaaatctagtaaaagaaaatagagggagaccctttcagaaaggttataacatatacactgagctcatgacacatggtattgttaatcttctaaaaagaaagaaaacttctagagaaatagtctatcaggaaaacgttggtgaaataacatggcacattaaccacacttgaatatatttggatgttttgtgccacaattccaagagacaagtaagtattttcttaaccttgctgtgtaaacaaagccactgaggcatggagcaattataatgcaatgccccaggtaaaataaccagccagccactgattaaaaccctaagccccaagcactggccatgagctttccaaaaaaactgcactccgtgaagatgtttgctgagcaaaggcaaaacttgccttggtagaaaagaaaaatgcaagggtcaaaacatattgtatgcgtatgatttttttctttgtcactgggaatccttgagaagggttctcccacaaccctgcctagcacccccgccatcctttctggtcagtgatccacaattatttagtgggcagcacactctagtggagagagccacagccaggagctagaatgcctgggttcaggttttttccactcagctgggttgaagatgagtcaggtatcttaaatcacacatgcagcagccaaacagaggaaatgaagataattgtgatttttctaaaacttcctatcctgggggaagtggtaaaacaatacaaaagatggcccacttagaagtggtcaaccagtgaatgaaaattcagccagttgtcagtgaagcagcactctgaaggaaatgccagccaagaaaaggagccacacccccaaaaaaatctaatatggaattccgtggccatgatagagatcaagcagcttccctacaataaaataaatttctgtatacacacatttcccatgtttttcatcccaggaatatgtccacatagactatgtggtcttgacttacaccatctgcatagattaaatgtattttatgtaaattatcccagtcatggtcctataaagtcaagtggtctgaaaaaaacagttaagtgaaagttacaatctaatcaatatataaaatgcatggcacagaactggaactctacttcttgggctcttgctcgggtaccaacaacagcaactaccattatggcattgggaaatgcagtcaggtatatggaaaacgtggaagcctaatcaccaccttgctaaagatcttataaactttacacagatgatatccaaaattacagctaaatttacacaacccagtatagctacatggcgcactgccatggaggagcagggtgagcctcagttcctgctgagtcctcataccatcactgtgacagcccagaaatgagaacagaagtggctctagccagctatccactccatacactcagaggataaaggaggcaccaatgaccataaaagatcctacggggaatcccttcaagaagcaagagtctccaagtttgttaaacattcaacaaatcctctgtgacttcttattccttttccaactcatattcaaaggaggagatactagggtattccaatacaaataatttttaaaaattaataaaggctatctacctaatagaagtgttttatactaagacattcatttatatcatacatatgcacagatacagatgtacctctacatataagcacacatgcacattcacacagctacttacacagatgtgcatttataccatatgtgtatatataatagtataacttgctattaattcaattaataatgctatcataagggaagaaaatctatagctgcatgatttaattttttttctttgtaccataaatggtttttattacgtttagtttatttgagtattcagattattttgcagttcatgaacagaatatgacctatggacaagacagcctcttcagaagcaggctaagtaatggaaagagagcaattcagattaaaattttgttccagaatacatatcaagtgaatagccataaagttaatggtaactatttactcttatttatggctgtattcggctgaagtggtaaaacaatctcaggaatctctgtccgtctcaagtttttatagttttaggttacatttatgaatggatcaaatcagaaataaaatttgaatggtataattcagtgcaaataaaatatacgacaatccttttggcaaagacataaaaaaagaccaagggagcaccagactctctctctgatgctattaaaatttaacagttctggggctagcctgtaggtccgactcactggacttatggttaggcacaagtgaaagaggcaaagggtggactcaggaccattgcctcgccctctaaatccatggccaccttgggcttgtggcaggggctagaacttgttatgctaataagatcccctggatttgaccaggatctactaagagcaatttataacaaaattgtcactcttgagacctatttagccagattctcctttttactgtaagaagtggcctcacagtgagctgcgattggaacaagcaggtaccatggtgctcagagagaccaatgctgacatggtatagaaaaggaatatgaaataaactccaggaaatcaaaagaagtggatggtcctgacacactggtatcctgagaaacatgcacagtaagaagataaggaaaaacctttggcctctgtgactctgcagtcacagtagggttcctgattacttcaacctcatgttaatcttgacgtaaaacagacacagcccacccctagtgctcatatcagccctccatgctactcatcttcctgacctcagattctcatcagaagttttccttctcaccttctacataaacttccgtcttaattcagcctctctctgcattggtactctctaccttggactctctactgttcctcataccaatggtcataatcagccatccatttttttctctttcttttttttatttttgagatggggtctcaatctcttgcccaggttgaagtgcagtggcatgctcatggctcactgcaggctcaacttcctgggctcaagctatcctcccacctcagcctcccaagtaactgagactacaggcatgcgccaccacacccagctaatttatttaattttttgtagagattaggtctcactctgttgtctaggctgatatcaaactcctggcctcaactgatcctcccaccttagccttccaagtagctgggaccacaggcacatgccaccatgcccagcattttttttttttttttttttttggagagatggggtctcactttgctgccctggctggtctcaaactcctagactaaagcacagccatccatctttacatgtgcagttgttccactacaaacaaatatgacactgccctaagatgaattaaagatattattagtactaactaccaatgtctagtaagcattttttgtgggctaggccttctgctcaagagttttacatgttattctttatttaatttcctatcctttgaggtaggccctatggtcatacttctctatagaggaggaggctgagccttagagaggctctgtgtatgctagctggtgagtgttggagctgggatttaaacccaggcaatcagacttcagggaacattcactcaaccataacacacagctgtccctttcagttcctcagcacttcacagcacaaatgtctggaattgaagggtgattggtgatttctgactatgtgctctcaaaacattcatccaattggatacttacccagataggtgagttgcctcagctggctattgaagaaccagtcacagccttggttctgacctggtgatggaagaaatggaaaagacagacccactcgactcccacatcttaggaggatgtcagggtaaggcggcaaatctgtgtgcaccagcagtaggtaattaccaggagcaaagttgtcaaaggttgctgagtacttgaagtgaaagaaaaacacaatagtgctcatttagtaaggaaccccatcattccacctactccaccacaccaccctgccaaaacaactacagagaacgcagatggagtagtttagaaatcatacaatttagacccagattgtacttttcttgtgggaaatgggaatacttaaatctacttcataaaaaattcataactagagctacaaaatcagactatgaagactgaaagatgccataaggttcatctcgtttaacaatctcaattaccagaggagaaagccaaggcccagacatatgaattgacacgtctcaggtcaaacagctagaagagacaaggccaggtctagaattcctttccagcttttcccacgacttgaagcgacaggcaatgataggcatgtcatccatttatcacagtaatagctaacattgtgggagcatttactatgcaatcagcactattcagtcctcgaaaggcacccctgtcattgttactcttactgtcccatttttacattgaggaaactgaggcaggcagaggttcagtagcttgccccatatcacaaagcagaagagtgcagtgtcaggacataaacctagggtatccacctccagaggcacaccctactgttttcactgcatgaaaattctccagagtgctctcacgggaatctcaaggcaagaaaagagaggcgtacatcctttctgaaagccatggagagaagatcaaaagtgattctgttctgaattcctcatgaccatggcagggcttctgtctccctaagataggctctcaggactgttagcaagaatgtgtatgataagataggaagaaatatatgtgttaaaagtatgaaaataagcttagggaattccactggattgctgtttaaaaatatggaaaaatgtacccactttcctcatggccatttttttttttttagtttttttttttatttcttctgaaaaaaaaaaaaacaggatacaggtgcagaacgtgcaggtttgttacacaggtatacgtgtgccatggtggtttgctgcacctattgacccatcctctaagttccctcccctcacctcctacccccaaacaggccctggtgagtgttgttcccctctccatgtccatgtgttctcaatgttcaactcccacttatgagtgagaacatgcagtgtttggttttctattcctgtgttagtttgctaacgatgatggcttctagcttcatccatgtccctgaaaaggacatgatctcattcctttttatggctgcatagtattccatgatgtgtatgtaccacattttctttatccagtctatcattgatgggcattttccatgtctttgctattgtaaatagtgtggcaataaacatacatgtgcatgtgtctttacagtagaataatttataatcctttgggtacataccctgcaatgggattgctgggtcaaatggtatttctggttctaggtccttgaggaattgccatactgtcttccacaatggttgaactaatttacattcccaccaacagtgtaaaagcgttcctgtttctccacagcctcaccagctttcattgtttcctgactttttaataattgccattctgactggcatgagatggtatctcatagcggttttgatgtgcatttctctgatgatcaatgatgttgagctttttttcatgtttgttggccgcgtaaatgtcttcttttgagaaatgtctgttcatatcctttgcccactttttgatggggttgtttgtctttttcttgtaaatatgtttaagttccttgtaaattctggatattagacttctgtcagatgggtagattgcagaaatattctcccattctgtaggttgcttgttcactctgatgatagtttcttttgctgtgcagaagctctttagtttaattagatcccatttgtcaatttttgcttttgttgcaattgcttttggcattttcgtcatgaagtctttgcctatgcctatgtcctggatggtattgcctaggttttcttctagggtttttatggttttgagtttttcatgtaagtctttaatccatcttgagttaatttttgtataacgtgtaaggaagaggttcagtttcagttttctgcatatggctacccagttttcccagcaccatttactgaataagagatcctttccccattgcttgtttttatgaggtttgtcaacgatctgatggttgtaaatgtgtggtgttatttctgaagtctctgttctgctccatcggtctatatgtctgttttggtaccagtaccatgctgttttggttactgtagacttgcagtatactttgaagtcaggtagtgtgatgcctccagctttgttcttttgcttaggattgtcttggctatacagggtcttcttcgattccatgtgaaatttaaaatgtttttttctaattctgtgaagaatgtcagtggtagtttgatgggaatagcattgaatctataaattactttgggcagtatagccattttcacgacattgattcttcctatccatgagcgtggaatgtctttccatttgtttgtgtcctctcttatttccttgagcagtggtttgtagttctccttgaagaggtccttcgcactgcttgttagctgtatacgtaggtattttattctctttgtagcaattgtgaataggagttcattcatgatttggctctctgcttgcctattgttggtgtaaaggaatgcttgtgatttttgaacattcattttgtatcctgagactttgaagctgaagttgcttatcagttcaagaaattttttgactgagatgatggggttttctaagtataaaatcatgtcatctgcaaagagagacaacttgacttcctctcttcctatttcaatgccctttatttctttctcttgcctgattacccggccagaacttccaatactatgttgaataagactggtgagacagggcatccttgtcttgtgctggttttcaaagggaatgcttctagctttggcccattcaatatgacatttgttgtgggttggtcataaatagctgttattattttgagatatgttccatcaatacctagcttactgagagcttttaacatgaagggatgttgaattttatcaaaggccctttctgcatctattgaaaaaaatcaagtggtttttgtctttggttctgtttatgtgacggattatgtttattgatttgtgtatgttgaaccagccttgcatcccagggatgaagccgacttgataatggtggataagttttttgatgtgttgctggatttggtttgccagtattttattgaggattttcacattgatgttcatcagggatattggcctgaaattttcttttttcattgtgtctcttcccagttttggtatcagaatgatgctggcttcataaaatgagttaaggaggagtccctccttttcaattgtttggaatagtttcagaaggaatggtaccagttcctctttgtacctctggtagaattcagctgtgaatccatctagtcctgggctttttttggttgtaggctattaattaggctattaattactgcctcaatttcaaggcttgttattggtctatttagggattcagcttcttcctggattagtcttggtagggtgtatgcatccaggaatttatccatttctcctagattttctagtttatttgcatagacatgtttatagtattctctgatggtagtttgtatttctgtggggtcagtggtgatatcccttttatcattttttattgtttctatttgactcttttctcttctttgttaatctagctagcggtctatctattttgttaattttttcaaaaaaccagctcctggattcgttgatttttttggagggttttttgtgtctataactccttcaattcttctccgatcttagttatttcttgtcttctgctggcttttggatttgtttgctcttgactctctagctcttttaattgtgatgttagggtatcgatttgagatctttctagctttctgatgtgggcatttagtgctataaatttccctcttaacactactttagctgtgtcccagagattctgatacattttctctttgttctgattggtttcaaagaacttctttctgtcttaatttcattatttacccaggagtcattcaggagcagattgttcaatttccatgaaattttgtggttttgagtgagtttcttaatcctgagttataatttgattgtactgtggtctgagagactgtttgttattatttcagttattttgcatttgctgaggagtgttttacttccaattatgtggtcgattttagattaagtgccatgtggctctgagaagaatgtatattctgttgatttgggatagagagttctgcagacgtctactaggtccactcgatccagagctgagttcaagtcctgcatatccttgttaattttctgtctcattgatctgtctaatactgacagtggggtattaaagtctcccactattattgtgtgggagtctaagtctctttgtaggtctctaagaacttgttttatcaatctgggtgctcctgtattgggggcatgtatatttagatagttagcgtttcttttcttgttgcattgttccctttaccattatgtaatacccttctttgtcttttttgatcattgttggtttaaagtttgttttatcagagactaggattgcaaaccctgtttttttttttttctttccatttgcttggtaagttttcctccatccctttattttgagcctgtgtgtgtctttgcacataagatgggtctcctgaatacagcacactgatgggtgcctgactccttatccaatttgccaatctgtgtcttttaattggggcatttagcccatttacatttaaggttagtattgttatgtgtgaatttgatcctgtcatcttgatataatttagttattttgcacactagtcaatgcagtttctttgtagtgtcattggtctttatattttggtgtgtttttatagtggctggtaccggtttttcctttccatatttagtgcttctttcagctcttgcagggcaggtctggtggtaacgaaatccctcaggatttgcttatctggaaaagattttatttttcttttgcttatgaaacttagtttggctggatatgaaattctgggttgaaaattcttttctttaagaatgttgaatattggcttccaatctccactggcttatagagtttctcctgagaagtctgctgttagtctgatgggcttccctttgtaggtgacctggcctttatctctggctgcctttaacagtttttccttcattttgaccttggacaatctgataattatatgttggtcttctcatggagttggggttggtcttctcatagagtgtcttaatggtgttctctgcatttcctgaatttgcatgttggcctgtcttgctaggttggggaacttctcctgaataatatcctgaagtgtgttttccagcttttttccattctccctgtctccttctggtactccaatcaatcataggttcagtctttttatgaaatcccatatttcttggagaccttgttcattcctttacattcttttttcttgtgtgcatgtcttatttcagtgaggtggtcttcaaactctgatatcctttcttttacttggtcaattcggctgttgatacttgtgtgtgcttcacaaaattctcatgctgtgttttttggctccatcaggtcgtttatattcctctctaaactggatattctagttagcaattcctctaactttttatcaaggttcttagcctctttgcattaggttagagcatgctcctttcactcattgtagttttttattacccatcttctgaagcctacgtctctcaattcatccatttgatcctccatccagttctgtgcccttgatggagaaatgttgtgatcatttggaggagaagaggcactctggcctttttggttttcagcattttctcgttgattctttttcatccttttgagcttgtctagttttggtctttgaggctgttgacccttggataggatttttgtgggggcctttttgttgtttttgttgttgttgatgctgttgttgtcgctttctgcttgtttgtttttctttcgggtccctcttctgttgggctgctgcagtttgctgggggttcacttcaggccctattcatctgatttgctcccatgcctggagatgtcactcaaggagacaggagtgcagcaaagatgggtgtctgttccttctgggacctctgacctcgaggggcaccaacctgatgccagtaggatcgctcctgtatagggtgtctgacaacctctgttggaggatctcacccagtttggtggcatgaggagcaggacccgttcaacaaagcactttgtcccttggtggagagggtgtgtttcactggggggaaacccactcgtctgggctgccgggattcctcagaactatcaggaggacaggccaagtctgctggtccacggagactgcagctacccactccccctggggctcagacccagggagatatgaattctgtcccggagcctctggctggagttattggagatcctgcggggaagccctgcctgcccactgaggaaggatgggtcagagttaggcccaaagaggcactctggctgcagacagccacagctggtatgttgggctgtggggacaagtcttgggacaaagccatccagcctccctggctccaacagggaaaaaacgcagcctagagctatagaaatgggtgctgcctttcccccatccacagagcttagcatgttaggcagttgcaagtcccagtgctggctgctgcctctcctgagctccaaactgggagctcaaatggcttagacagcaggcagctgcagccagtgctggtcgcccctccccgcgggagtttggtaggcttaagcagattccagctgagaggctgtaagaatctgcttagggctctaggcccgggtggtggtgtgggttcgcgagtgggatcttccgacccatgggttgcacaattccgtggaaaaagcagtttccccggctgggtagcggctcactcaccgcctcccttggctgtggggaacggagttccttttccccgtgtggctctcaggtgggccaccgcaccacactgctcttccttctctccgtgggtcacgccagccttctagtcaattttgataagagaacctggataccttggttgccgatgaaggcttcacatgcttattatgtttttgttttgttttttcgatggtagcctccgaacgtctctgtttctagtaagccatcttgccacacggccatttctatcttcactgctcttatttgtctcccttaacccaatccagcctggggactcatacagacttcgattggcaagttaatctttgaccacaaggtggcagtatgcaatgtataaatgctttggtaaggcattttctctggctacaaacacttctctctagggtaaattggctattgaccaataagttttaaagaaatgcaatgctataagatgtgtagaggttgtttctcattgtattaataaatttaaattttcaggcgtaaccattctgcattcacaataacacataaatagattctaaaattttcaagtttaaaaagcaaccaaatctcatatttagcttatattcatctggccaaaatactattgaagttttctttatctgcatcagaatatgccaagactttcaataacgagataacctgctcctctttcaacccattatctcaaacaaagaaagataagaacaaatgagaatgcagcataccaactaatggattccttgggttacctgcagagatctgttgatccaaaggttctcagattgcaatgagtaggtctcttggtccaagagcagagccatccagccacgagggttagacaatgtatcacgtacataattgacagtggttgttttatttctgctgtcagtcatggttaaatcataagaaacttcaggagtattcgctctaaggtgattttaaaaggaaaaaaaatgggttgagagattatttgctcattctgaatccaatacattcctctttcatcaattgcaatcatctttccattctctccacatatgtcttaggccctctttagttgtatgtctagggaggttttagcagtcactgtgtgagtgaaaacaacccagtgggaagttgccattggatcatttgcaaattacaatgtcctggtgaactggaggtggtgactctcaggttttttattttgtttgttttttgtttttctccttgagacggagtttcgctcttgttgcccatgctggagtgcaatgcgcagtctcagctcactgcaacctccaccactaataaatgtcacattaatgattttgtatgaaccaagactatatactatgattttaacaaagaaatgtctatggccagaattttgccttggaccagatttatcaacagcaaaaaacattattattggtaattggatattcacatgaggaacaattgacagaggcctgggacctgacatgcctaggtgctgagactctcagaagtcctgctcaaaatgcccagcaggagtggcttcagcatccttctctagaatgatgaggtaacctgctcctctcctgcagtcttgtgtaatgcctagtactcactgctattacagtacctatgtgttcttggctttgcctttttaaaaacatagattataagatccctaagttagaggtgttttcccctttcttattggtatcctctgccctggcacagggcccagcacacagtggcacccaaatcatgtttgttatatgaatgaacaatgcatagatgagatcttccaaaagcagccagtgacattttctaatgtatataaagttctatatatagaacgtataaaaacgttcagaagaactgcattttaccaaatgaggagactgaggcagggtagagcaaaagcaatatgtgagtatcacaaagtagaactcgaaatttgtgaatccagttacccaacttattctatacagccatcccagaaaatgatttttaagacttcattaaagcataagtagatttagccaatgattagacccctaaaagagagtgaaagtggacctaaagaaataaagcaaaatccaaaaaaaaaaaaaatcaatacacattatgactgttcttcctcctttggtttagttttcatgagaatctttaactgtggcattttgccgcaggcagataattaaattctcaaagtaagggaaatgagtcaaaagaggacattgggttttcacagtgagatggggcatgagtatatctaaagccaatttataagcccgtggaataattcaaaaaggaacttttttaagtgttgcacacttgggcactggaacaaatgggtaacaactgaaatctagattggcactcagtaggtgtgtaaacctgggcaaatttcagcacctatttaacctttagattcatttctttttaaaatggaggcaacaatagaatagatctcatataggtactatgaaacataaagataatctacataaagcactcaccaaggccaataacatctacttaggtctcatttaagaacctcaaatatgccagatttaccattctgcactacttatttgaatgcctagaggtttattcaggatattcggtcatttaaaaacataccaaaaacccttccatggtacagatcattgaccctggcaatgtagcacttgacacatatttcttgcaagattaaatgtatttgtttcatccatgaactaatgaaatgaaagggatgaaaaatgctcagggcatttgggaatgaaagaactattcttttttcagatttccctatgcagcattaactgaacctttagaaatcttgtgaggaggggaaaatgtcttcctttctttgggttttagatacttaggtttgttgtccacccttccccacccaccccttcaggatttaaattggaactaatggacaattctcaacctatattcttagaatcagaatgaacacaaagatcatctgttctaatttccaattcagtgcaggaattcccaccatatttcatccctccccttctttcagttatggggtgtttacatcttcgaatagaaaacattccatatatgggatttagttttaaattgtaatctttagaaaagctttagaatgttaaatttcccttcttagaatttctagccatttgcgctcagtcatcatggctctctcttcccctgatggaaaccatgagtcccataatcccaggatattttccaggaacaatttggcccaactatatttagcaaataaaaataagctttggggacataagtgtaaaacaaacatgataagaggtaagttcgaactaagaaatgtcaaaattggctacagtaggtactgtggtcagtaaataaaacacactagaaatatctaaatttcctcaagtacagggaatgattataagtgtttcaggttccaaaagtatatccttccagtttttactgagacatatgggcttggatttatttaaataaatcttgtgatttatttaaatcacaagacctaaatccaagagagactaattgataaatcagaatttttagttaatgattgaccataagaaataaaagtgcctttcatatagtgggagtttaacaaatattttctgactgaataaacaagtgttatatgcatcagaacactccagctggttatgcagtaacatttctccccaacttggaagtctacctagaaaaatcacatgagggtcaagagatttcctgcaaacttattttcaaaagaaatcagcagttgggtgatcctaagttattagagcttgatacaatcaaccccatatcagtaggatatttgccaagaggacaaacatagtcagtggtcagaaaacctctcctaggcacacacaagcaatgtgcactaataatggtctctggtctaggaaaatgctatgatttccttgaaaactcatatttctgcaatcctagtcaagtgctgtcaattaaaccactttttaaaaatagttttaactacaaaccaaaagaagatctctgttcaaaagcatccatctgttcacatttaattcctcctgcctcacctatcttctcatgcataccacgttgatcattaaaaaaaattacctcggccgggagcggtggcttatgcctgtaatcccagcactttgggacgccgaggcgggtggatcatgagatcaggagatcgagaccatcctggctaacacggtgaaaccccgtctgtactaaaaatacaaaaaattagctgggcgtggcagcatgcgcctgtagtcccagctactcgggaggctgaggcaggagaatggcgtgaacctgggaggcagagcctgtagtgagcagaaatcgcgccactgcactccagcctgggcaacagagcgagattccgtcccaaaaaaaaaaaaaaaaaattacctcaatatgtgatagtataatcaattgggtagatatttccagaaatattttttaattccagcaatgtggtcccaagaattcccctggtcaccttaactggacttaattgctcgtcaaatttcaattaacaccacatttacagaccaatttttaggatgttatttcccctgactcagtttctgtagattacaatttcaattattgaaggaagcatttttcagataatctccccagtttctgaaggcccatacaaatgtggtccctcttcaaatagtgtcaaactgctaaatgctagcaataatttggttctatttgtctttggaaacattgcaccttccttttgaggttcttctccttctagtcagaatccaataatctgatgcaaactccttggccaaccagagacataccatagcacactgtgatcctaaattactttcttatttctccttcatgcactgctcattctctcagagccttgagtctatcaagctcccctcacccatctcaaccaaggtttattagggatgcaatttcataggcactcatgtgcagcaccagctttctgtagtgcaatacaggtagagaaggaggttatcatatatactacacttttatcacagctgataggagagagggtcatatggtaagcattcagatatgctttccactctgaaaagcaactcaaaaagcaaaagacccatctcccatcaggcaagatggcttgtactgaccatcaccaggggccaaaaattcagtcaggtcatctcctgtcctcctaggccaaatgccagaattgaccatggaggggtcttctgaaaagcaccaaaagaacatcaagagtccaaaaaacaccatgaagagaacttaccaacaataattactacaattttcacttgccctaaatagccaccaatttccccatgccctaaatagccaccaatctcccactctttactgttaatgaagcaaaggagcacaaaagtatttctaatttggaggagccaagggagtctgcatgggccattagcagtagagagcttcattactaggggaagaagtctctccctgaacttctcatggctttatgtgcaagaaatcaggaggcaaccagtccattttaaatgttaacccttacctctgcatcagcaacagctcctcctgtctatgatcaaaaagacaaaagggctataagccttacatgttgtttttcttttctgtgggctgtcttaatgtttgttcttttttattttattttttattttattattattattatttgagatggagtttcactcttgttgcccaggctggagcacagtggcatgatctcggctcactgcaacctctgcctctcaggttcaagcaattctcctgcctcagactcctgagtagctgggattacaggcacccaccaccacacccagctaattttttatatttttagtacagatggggtttcaccatgttggccaggctggtctcgaactcctgacctcaggtgatccacccgcctcagcctcccaaagtgctgagattacaggcgtgagccaccatgcctggcccaaacctgtttttaattcagggaaatgttccattagaaatataacactatcacttggtaaaacttcctggtcaaagtaccaatttaccatactagttacttaaagagttatgtaacttagtgcccatgtactgtaaagaactgttgaatcccacaaaggatttgttaggcaatcaataataccaatgagagcagatattaactccctggtttttgtttaccattagcttacttttcctgagggtccatatctgtgtattaaagacaagcattgcacagagctctaaatgctcttgatttggaacagttgtgaaataaatcctctgtaattatccatctcctaagccagacacaccacaatacctaacctcaaattgtgttgcaaacatcttctgagtatttgtgcttgttgatgtcactctcatcttttactgcacaaaggggaagaaaaatcaaaactgtgggcacagccaacaaatttctgtggcatggttttgcatgagcatcctttaaaaatacaccatgctcataacaatccttgtcacagcaccactattctatctgctaacacctgccaccattccgtaatatttcattatcattgtatcattaagtttttccatccacagccttatggattcagaaacacttaaatatttctcctctaaggaagtatctacagtttttgcaacatagttatctgctgttatattaggacaatactttttgcccattctatcttaatatatgaagaaaagcaatagatgtccattatcctactttaggtgaccatataccattgcatctctacttttgatctgctgagtccaattggaatggctatttgagaacacgagaacactgttattgaagctatgcaaccagaaggtagacaggtggacaactgcttgtcagggatattgaaaaatattttatccagcaggtaggaagttagactaagaagcttgtcctcccatatatatgcataccagagctgtgatggggatgactgacactggctggcagaagcccatcattgacccttcttcccaactatatgttcagtgcttttaggttggaagcttaaaataaggcatgtgagagtattttcactatagaattaggcaaatgaaataaaccagagctttttattctggagagctagttgttaaacatttaccagcataccactgcaaccttttattattcataaaacttaataaccatgtaatattgttgatgatattcctcagtttggggtccattgtgatttttagatctttttctactttaattctgtaacctttgctgccaagaaaagataatacatctttgaattttcttgtctcacagggttgttttttaaggactgaaaagataccattagtgatgccatgcctatttatccctaggaaggaaagtcaagcgattattagaggaaaaggtaggccaaaatttccatttgaactcttctttatttttgcattcacagaggcagggggtgactcgtactttgaacactgacaccttaagagtggttacataggtaaaaactgaacgcaagcactacaggagaggatattaagcaagatctaagaatcaaggtgatcaacaagaacactaaccttttattttccaggagaggtgggaaggaagaaacagaaggtactggggcacgatgaatcaaagtcaacgccctgaatgacctgaggttctacaaccacctgggaggttttgctgggtcagtacaacgtcatatgattattacaaattattccctatttttcaggaattggattaagttacattacctaattcccttgccaggcatttgtttctcagaaacaaaaaattctgcagtaacctattcaattagtattatgcctatgcgttgttttgtaaatcacaaatgtaaaatagatattctttaaagagtacctactacatgtcaagcaatgaccctgagggataaataccattatacccattttagtgatgaaagaactgaaacaaaaagcggtaaagtaacttgtgcaaagaaatatacctaggaagtagaggggatatgacttgtacccacaaaggattgttaattacttctctattcttcagtctgaaaaataatttcaaacatgtactgtatatatgtcttgactattttatgtacgtcctgtaaaaactcagaaggactggtcagccaacctacaaaatcttgcaagctcttctaatctccctcacactcaatacagtcaaaaattcgaagacagaatcaaggtctgatctgttgatatctcaatgagtctacgacaagtgaagaagttatacattgctgtaaacaacaatgacaaaaattttcgagaaaataattataagggttgagcttacatcctctctatcacagttttatgtacctattccaccaggacaagaaaacaattacaaataaaggcaaactgatgattgaatgggggtagagaggggttggatagagaaggaatcagcaattagaataaatcctccagtcaaatgattgccccaggaaagtaaaagcccagagaagattatgaaagaagattcttaaatactagatattcctaggaattttagaagactggagatagcattttactcctgggtcttctgaagaaaagccgaatgctgtggactcctcatgaacatgtcctaggagagaaatagacaataaggacactaaaggaagatctgggggcagtccactattttttatttatatttttttactcaacaccaattttgttgagttgctatgtgttaaacagagtttggggcatcataatacaaagaaaatccctatttgccctccttgccatttataaggacagacggacaatttagaaagctatgcaggtgctataagtactgattagagcaagtataaagagctagcacacaacagagatatcaaaacctgcgcagcatgctcagggaagcctagcagagaaaacgacctctatgctgagttcatggaagctgaacattatgaattgaagagcacaaataagttgaatgtggctaagggacagaatgcaggaaaggtagagcagagtgctgagagataatgctggaacccaaagcagacagcaggacacggaagctccatgacacattaggaatgtcagactttccttggaaagcactgagaattctttaaaagtttcacgcaagggaatggatggcaagatcagatctgcatttagaaagttcagagattgaaacaccgaaaaatggcaagctaagtggctgttgtggttctacaggtgaaaagtaatggtagcccagactggagaaggatttggggaaggagagtagtagaaagactcaaaagggatttattaaggaggaaaattgagctgataggtgattagtgtgggaaataaggtacaaagatgagtcaaggatgactccatgtttcaggtttagaccagcatttgcctcagtgggattctgagcacccagagagaaacaggtctacagaaaaaaatcataaatcccattttggcaagttgagttttagagtagccacactaaaaagctcaaaataaacaagttaaattaattttagtaatatatttagcccaatctatccaaaatattatttcaacatgatcaatataaacaaattattgagatattttacattctttttttcatattaagtcttatctatatggtgggtaattcactcttacggcacatcacaatttggactagggagatctaaaaagagcacacaaaatcctactgataatattgtacttgtttcgtgtaattatttctatacagaaaaaaaaaatgtttacctaaagtttgggatagataaatccaagaactatgtgggacattttataattatgggaccctggagaaaaactgtcactggcatgtgtttctgatatgaggtcctgacttacattggcagaactaacactacccctgtctcaccaggaacactgaggttcatagggggaagctggtagaaacagaagctgggaaaggaacgctatccagaatacctgcggcttctacagaaagcatgttttcagagctgatgagagagaaaacaatataagcagcactcacgcagatcaagcatgctgtcattttaacaaaacataaactagactctgccttgtagagtggcagttttttcttcacccaaatattaaatagtgtggccaacttcaaatatttaaatacttctgtcatcccaactgctggctttgagtcataggaaccaataaagtaggaagtgccacaaaggtaagcaccgtcagatttaaggcagtgagggacaggaacagaaggttgccaatgtcaaacaaataacttatagtgaaaatggaccagagagggggcctaccaaggaagaactcacactccaagagcttggttcttagcagaacaggaagaggatgtcttgtttatgcagctatgtaaagcctcactccctgccctctctggacctcttactgagggagggagttaagggttgaaagtgaagacagcagggtgcttatgccatattagatctccatcaacatgcaaccccaaaagatcataactgtgagagctttgtaaatcaactcttagggtgcttgccccagggcaaatagcacaacaaattaatcctttctccatgaaatgcagcaaagtttgcatctatgctgaattcaaattgctcattagctctgacatgttcctaatgaggttataatgctttgggacaaagatcaagccactgagcacaaatagctagggatagaatcatagaaagataaaattagaaggaccttagaggagtgcctctcagactttaataccaatcacctgggcattgtaattcaggacatctggggcccagtctgagagtctgcatttctaaaaaaaatccctggtgctgctgctgctgctggtccatggacaacattttgagcagcaagaccttagagatcatctaattcagttgcctctcctagaggtgagcacatcagggccaagagatttataactggaagcacgctgagacttccaggtgactaattagggtcagttgagtatttgtccatagacctgtgagtcaacctgaaaattttaaatagaatctaaggagtagagtgaccaatcagcctagatgactgaggaagtttccagaacatggaatttgcctttttaaaacaagaaaaaaatccaggaaaaccaggataagtttttcatcctgctagacccttttgaatctacttagaacacagtatcagtattacatttttcttgaccttgtcagtccccaagtggtgggatcatgacctgccaaggcaagtaccttaatatcctgtcccaaagatctcaaagagcaaatgctcaaacaagtttcaggcactacagagccttctaacatcacattgacaagtgcctctccaagagacagcctaccagtagatctcaaagtaaagcatgataaaggactatcaggaacacgcagaaataaatattatagaagcatataatgttccttttaagtacacaaatctattttcctcatttgataaaatgcatgtaagaaataaatcactaatttttataactctcaaaacactcatttaaaacatccttggtaaaaacactaaaataataaaaatcaggctgcatccctgagaatgaagaaaaagtcatgctctgcacaatcaaaatgattagaaataaaaatatatccctacatattattattttactcactggaattgggctcattaacgtcaggtagaataatgaatgtctagaaagcaaaaatgaaaaatttccagactattcagtgctaccagtgcatcgctaaggcttctaaaacagaatgccaaagcactgattccacatgcattcaaaatacagagttagtgcaatcctaaccacaatgattctcactccctgaagtttacttgttcaagtaagaggccaatgaggtctgactgaattacttgacttaatactcatggagttaggacacttaagacaaaggaagaaaataagtgtggctaaatatatacaatgcatttggaataagtaaaagacagaaccctagacattcagcaatcattacctggaaattaaagagggcaggagcaatcctattatgcattataaacagccccgctgctgacttaatggtagtttgagtagcataaccaaggagtccttgctccaatattaataggaaatgtattgtaggaatccaatagttcatgaaattaacaaggaaaatgaactggagtgaagcaaccttgcaagtaataggaggcatcagcaattgcttccctggagcatattgaacacttaaaaagagcttgggaagagtacatgtatataaatgagaatggacatttttagaattttttaataatacttttaatttaaatatatttcaaactctctgttggctgtaagtctttctaagaagaagttattagcccaaaatgtcaatgagaggtcacaagctatgagatctggtccaaagatattgctagttagctgccatttgagtcagcttaaaactaccatacactcatgattcagcagctgtcaaaattattcccatttcacttctttagagctaaatacttcaaataatctagaaaacaatttcccttctataagcctcgacagccagaataacagatgcatgcccatcggcaagctaaaaagtatagttaattccacttacaaaccaatagacatacgatgaaaaagaacacctcctccacaggcactgccatggacaacccgaccaaagcttgaattgaccaaacaagaagctgaaagggtttccatagaagcaagaatgtgacttctgtttttcccagacagagacccatccaagtcttccaaaattgctgcatgaggaaatggaaatgccactaagtttgaagagtttgtaaacttcaactggctggtcttcacagtaaatccacctataaattggaaaacagaaagattattacacaatggcacaaatagcaactaaattcactggagtgatggtcttaggatttaaattgcatatttatctagttttacaattcacctattcatgcaagaaaaaaagtgttttctgtgggtgttttacagtgagtgtttactgtctaccaagctctggtgtgctagagatactaagaggtataactgcagcattggccctaccttcatgcagtctatagtccacattgtagggcagtgatttttctatcatggttgattttaccttccaagagacatggcactattttcaatcatttttggctgtcacaattggggagctggcagtgctactggcagctagtaggtagaaaccagagatgctgctaaatatcctacaatgcacaggacaatccccacaacaaagaattatctcacccaaaatgccaatagtgccaagggtaagaaactctggtctagtgggaaatagaagcagaaaacattaatttattaattactaagcaccaaagatgctatggtttagtcttccaatctttcagctttcattcctctgtggtgagtctaacccctccaatacctcttactataaggtttatttaaacatttactttcaaaagcaaactcaattaatcacttgggcaaatagtattagtaatacactttctaagtattagctgtagggccacacttcttggcagtctttccccaacaccactgccatgtgactcattggtactatcagtccaattgcctaaaaggaaagtatggcagtgatcttctaattcacacacccatgtcattaaaggaagaaaactaagtacacatctcccagtacacatactaccataccataatatattatgtacattataaaatataaaaaaaagaaaataaaatgaaaaagatacaaatagaggctctaatgttttcattctgcagcccaatagagtacatgcagtgaattgattcatacatgaaaggctacacaattgcacctcttgcaacttctgtatttcatttgataccacaaaccacctgcagctctacatttcagtcatactggacttctttgtgatttcccaagcacaacttacttcttggattctattttttgtgtgtatactgttcctagaaattcttccttgcatataccttcttgcaaacttctattcaccttcctaaaccctactcaagaataacctctatgagctcttgcctgacccccttcctcggccccttcactgactttgttgagtcctctattactgcgttcatcatgctctcttacaataataggcttggacatttattttagtgcctagatcaagagttcctggaggacagaaactatgtgttttttatatttgtaccccctaggtccttaagcagagcctgaaatagatggtatttaagcaaatgaaaagaggggttagccaatactattcagtgaaaagggattagagttcataggagtagtgtgattttttttcactgtctcatgaatgatatgaaatagtcaagatattaaagaattgaggaattgcgattgcaagcacttgttatgaggcatttttatttctattattatttctacaatcctaaactcagatgccacccaaataaaaacaatctttcattctgcctacataggaaaaaaaagtaaagtggagacttgttgattattcatttaattaaaaaaacaaacaattatctaaattggtgattcaaaccacaagagcatatttacttaaattacttggtttggctgtttacgatgatcaaatcaactagattactctctacctctttcaccttggcccatgagtcctccaagttatttcttaccacctctgagatgtggttaaaaagtgagcaagaactcctatgtttccctttgtgcatacatcaagccctggactgttgaaaacattaagtacctgaactttggctccttcaggaaaggctgtatgcatgttagtttataccaggtatctacccatctaactccattctttcatttaatcaataaactgcctactaggcatctggctctgtgctagctactaataattaaaactctgagcaagaaatacatgatctctgcctttatgaaggtcagagtccagcagagacataggaccataatgatagaatgtgataggcaccataataggagcaggacagggagctgcagaagctgtactgggagaacctccaggatgtcttttaggagatttaagcaacagtttctactgatgcaatcttataactgaaagagataatgattcacaaagtatttgccactatttataatactgacttgaatatgggccttatttatcatctgttctgtctattcaaataattaccttgtccttgggaacagtctgaacaggttctaatggccacacagttgatgagatcaaaattaacaaaggttgtgttagacaccatcagttcccatcttttaggagttttaatcccagatgacatacacagacttccctgtgatttaaaagaaaaaaagatgaaagcaaaataagaaaactggacacatgaaatacaattcataatgcatgaataaaaacaaagataaaaaagcgagctattgactaagagaaaatatttgccaatcacacatatgacaaaggacctatatccagaatatagaaagaactcttaggtttcaacagcaagaaaatagacaacgcaattcaaaaatcaggaaaaaaaaaccttcaaaagataacccagaaaagaaaatatacagatagcaaataagcacagaaaaaaaaaatgttcaacatcattattcactagggaaatgcaaattaagatcacactaaaatatactatgcacctattgaatgaataaataaaaatacagtgacaatagtaagtgctgatgaggatgagaaagtattaaaactctcctgtttctagtggaatgcaaaatgagacagccactgtggaaaactttggcagtttcttataaagttaaatatgcccttatcatatgacctagcaattcaactcctaggtatttaccttggagaaatgaaaacttacatttatataaaaacctgagacaaatgttcataacagttccatttataatcaccaaatatggaaacaagtcaagtgcacctcaataaatgaatggattaacaaactgcattacatctatctaatggaatactattcgtcgataataaggaatgtaatattgatatgtgcaacaagttagatgaatcccaatggcattcaggagtgaaggaagccagtcccaaaaggttacatactatatgactccatttatatgactgttgaaaaggcaaaactatagtgacagagaatatattagtgattgccagtggtttaaagcaagaggaggctgtggctacaaagatggagcaaggaactggggtggatgcaactgttctgtgtcttgattgtcgtggtggttgttacacaaatgtgtacatgtgttaaagctcatagaactgtacatcaaaaagtcagttttgctgtatattaatatattttaaaaactttaacaaaaagtctgaaaagaaagaaacaataagtgttttcatgattttccacaaaatctctttgacaaacactatccaatcaagctgctagtgcctcactgttccattgttaaaaatagtcttacatttgaggattaccagaatttttgcaatcactcccaacatgaaaaatgatgaaacaataaacaaatagcagaaaagaaactcagtggacacaaagctagtctagaaatcagaagaaaacaaaaactataattaatggccttggagaaataagtatattatatccatgaaacaaatagaagcctaaaatattatttttagaaaaaaaaggaaataggagagtagaaaaaaggaattcaatatcatagaaagtagaacaaaaagacaaagagatggaaaatcagtaagaacattaagatgagaaaaacattccaggaggcccaatatttaaataatcatagctttaaggaaaagaggaaaacataggggaaagaattatcaaagaaataattgaagaatactgtgcagaaggaaaggatataattttccagactgaaaagtcccactcagtatctagcacaatgtttagaaaaagagccacagcaaagtgcatcatattgaaattgcaaaacaccagggacaaggacaagttcctaagagctttcagagagaaaaaaaataagttacgtacaaaaatcctggaatctgagtttttgttttttggtttttttttttgagacagaatctcactctgttgcacagtctgcagtgcagtggcatgatctcggctcactgcaacctctgcttcctgggttgaagtgattctcctacttcagcctcccgagtagctgggactacaggtgcttgccaccacatctggctaatttttgtacttttagtagagacagggttttgccatgttggccaggcaggtctccaacccctgacctcaggtgatctgcacacctcggcctcccaaactgctgggattacaggtgtgagccactgaatctgagtatcttaaaactattcagcctcaagaccagaaggagctacaagatgatggaatattgccttcaaaatttcaatgcaaaatgaacttcaacctggtatcctgtaaccaacaatctactaataaaggggtctccatatatagctcagaactttcaccttccatcgtttccttttttttttttttttttttttttcagaaagttaccttagggtatgttcaaacaaaatgaggaattaagccagaaaagaagaagatgtacgaatcagaaacaagagttccaatactagacagacatgaaggaaatctccaggataatgttcaagggagattctaagatggagctttgaaacccttcttatacattgctggtgtaagcataaactctggattgttgcttggcattatccactaaagttacacgatgatccagcaattttacaacttggcttatattcaacagaaatgcatgcacatgaagaccagaaggcatatagaataatgcttatagcattattatttgtaaataaccaaacttacaaatgatgaaaacaaccaggtacaataagttacatgctttatgattccatttagaccaacttaaaaaacaggagaaattaatctatatcgatagaaggctgaataatgcttgccctttggctagggcgtgcggagtggggttgaatggggggacaagaagaggctttagaggagctgataatgttcatttatttattattagtttttattttttagagacaggatcttgctctggcaatgttctatttcttgttcttagttgtatacatatacatggttggtttgctttgtaaaaatccactgagctattcccctatgatttgtgcacatttctccataaatgttatatttccatgaaacatttaccttaaaaagtaggacaaatactagagaaaggtaacatagaagatgagagggtaaggaaagaagctaaaggagtttaatgtccttgcattacttatgtaaagtttaacagtgctgatgtaatttagactttgttaagacaagcaggcacattaaaaacttaaggccaatagctaaaataatcataacagaatggataactttcaaatgagtaaatataaaaatatgcaacacaagacaaatcaaaatagaaaagaagaaaaaaacagaaaccaaaaacggattgcaaattgaaagtgcaaaataagatggtagaaataaatgcaaatatatgggagacatcagcatgtggaaggtaattgaaaccactagagaaaatgagatttctcccagggagagctagtatattgagaagaaaaggggccctacaacagaatttagggaaacaaaaagatgaaaggtctaaattgaagaagacaaatccacaagtgaaaatgggaaatcacccctagagaaataggaggaagaatgaagcaactccatcagcatctgtctgaatacggtattttttaaagtagcatcatctgctcaaattaattacaataacaacgaagacagccatcctacagatacttcgataagtagggtgaccgtaatttaaattaaaattagacattttttttagtgtgaaagggtatgttaattagacagaatgctgggacaataggtataaacaaactacgcacccaaactaggatatatcgtcatgctatatagcacatgtctttcttgtatatttaagtcattcgtactgaaaattattctattcatctcaatacaaaggtaacattggctgtgagagtaccaacacacgtacaggtatgcttaaaggaaaaaaattccttctgatgataaaaagttcttccagaaagtaatgtttattttaggatgtgactcacagataattgtatgccaccaattatatatgagtggaaagtctaacaatggacaggccaaattctttaaaagtcttaattcctggccaggcgcagtggctcacgcctgtaatcccagcactatgggaggccaaggcgggcggatcacgaggtcaggagattgagaccatcctggctaacatgttgaaactccgtctgtactaaaaacacaaaaaatgagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccaaatattgcgcttttcagaccggcttaagaaacggcgcaccacgagactatatcccacacctggctcagagggtcctacgcccacggaatctcgctgattgctagcacagcagtctgagatcaaacggcaaggcggcaacgaggctgtgggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaggaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtgaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatcaacagaactctccaccccaaatcaacagagtatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactccatggaaactgaacaacctgctcctgaatgactactgggtacataacgaaatgaaggcagaaataaagatgttctttgaaaccaacaagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataacgaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacatagccaaagacaaaaaccacatgattatctcaatagacgcagaaaaagcctttgacaaaattcaacaacccttcatgctaaaaactcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaaaaacagacaaacagagagccaactcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatgggtaggaagaatcaatatcgtgaaaatggccatactgcccaaggtaatttacagattcaatgccatccccttcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaggctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaaggtctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagcaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaattaaaaaaaaaaaaaaaaaaaaaaaaaaaacacaaaaaattagccaggcgtggtggcaggtgcctgtggtcccagctactcaggaggctgaggcaggagaatggcgtgaacccgggaggcggagcttgcagtgagccaagatcgcgccactgcactccagcctgggcgacagagcgagactccgtctcaaaaaaaaaaaaaagaaagtgttaattcctaaaggaatggcaggcacaaaagacagaggctaaaatcagagtcccataaccacagaggtcaggaaccctctttttctttctttttttttttttttttctttttttggaacaactgacacctggcaacatagtggttcccaaataaatctgaaaaatactgtgctaagtaaagattaatagatttttttttgcttgttcactttaatgctagaatttctcagagcctttagtgtattttttcaatgaattttattctgtatatttgagatttacaacatattacagggtacacataggttatagtgaagcaaatcaacatatctattatctcacagttacttttctgtgacaagagcagccaaaatccacttatttaacaaaattccctgacacaatacaattttattatctctaatgcttatgttgtacattacatctctggatttgttggagattttgggaaatagagggtacggtaaacagcacagtataaatataattataaccaaataatcttctctttccagacactatctaagggctagcttttcatgaaaaacacttcagggaacattggtatgaacactaataaatgtcctttgccaaagccattttccatgtgcaattgaagaatatttgaccaggagtgggaggatatcagggtggtcctagctccacaatactaggcatgaaccttaaactgccattcaagtttccaagcctccattttcccctaagttcaagaagttaaccagatcatctcttaggtaatagttggctctttaattatgtggttttatgatttggataactaaccagcatctagacatcccctagaacaaaactgtttaacattttccaccaggggactcttgtcctgcacttacttaagagactgaaaggccctcagctgtactacattcctagtgaattacaccccaagggtgtgattatttttgattatctcatgatagccacccttttgtcataatttacatcttaatttttgtcactttcccattaattatgatgtctatttaacatcaattaagatactgcaacattaatttaccaagacagttactcagtttgctgggaattttgtttttaacatctactctaaggttatttctggaaaagttaaggacctctgatgtaccacagcatcacagaatctaaatctgggtaccatcctctcttgaaaactacacagtctgaaaggaagaatcatctctcaaggtggtaatccttttagagggaaaaaaaaactggcacttatttatctcctgaaaagtatagttcaaaggagattttactaagaaaagttgagagttaaatccaggaaaatgtagctcaataagaaaatgacttttaaaatcttcacatttttatctatagctgtgaaataaataatcttcaatggaagtataagaatcaaaacttatcatttaaatttcaattgaactaagcactcaggaacaaactgaagagaatattcttccttggctcccaataaatctatgatttccataatgatgtgatgactagtatgaatgtagttctaataaaaacaagaacataggggatccattatagacctgaagcctaagagaccaatggcagccaggaacccccacttaggaactagtgcttcccacccgggagtactctttgccccatctgcatccttgtaccctgagaagtcatctagagtctgatttttatcatgtggaaatccatacttaggcacatattagtgaatcacatacaaaataacgaactaggcaaatttctatttcatgatttgacctcttactatgagtaataattctaaattgcaaccaaataaaattctgtcagctacttatgacttctgtgatttatctgtactcataacactaaagcactgtgtatatatgagttctattatcaatatcaccactattacaaataaaaaggtcttttaacttttactaattaaatatgagattcactaaagaatgctattaaaattgcatatcctggatcatcagggggcccagcacatgtaattttgttgtgattgacagcctaaaacaaccacactaaggcacttaccttgtgggcaaaatgaccaagtaataagctgtcagtaactgaagtatttgcatcactttccaagacgtcaattccaaaatctctgcatgaataaactttgaagtttttcaggcgaagattgctacttctaaaaatctataaaatacagcatgttacagcaaaggtctgaggcttggtttttcttgcggacttcctgtagcttttaaaattattgattaagtagaaagaagcatgctatattgtattaaagcaccttttgtccatcaatgtcagtataggcatcctcaagttgctgtgaggtcagcactaatgagtctcctttggtaacacccctttgtacttttcatttctcctcataataaccaatacattaaaaagatcaatatgaattctccacatatctaaaataaacttggagtggccaaatcacacaaaggtaacagagaaaaacattgcatccaagaactctagtgcttaacattttcttcaatgtattatatattaactcatactgtcagaagattgcaaatatgaaataagcagctcagcatgactacagagtcactgtttgtaatttcaacataagttatgtacatatatgtttatgataacccaaacaggggtcatataataacaaaattagcttggtagagttgtaagtctactacttgctatggtttaagcctgtccccgaaaaagcatgttttggaagcttaatccctgatataacagtgttaggaggtgtgtaggttatgaatggattagtgctgattacaaaaaaaacttggggctgtgagttctatcacttgctccttctttgacttctttgcccttctgctatagactgatgcagcaagaaggtcctcagaagatgctggcctctcaatcttggacttccaagcctccagaatcatgagctaataaatttctgtttattataattttcccaaattttattattctgttatagcagcacaaaagggactaagacaccactggtctgggagacagagttgtgcttatgtttacgtctttgaccaattttttgctaattttatttattattaatacataatgactcatttgaagttaatttttgtaagtagcataaattaaggtaggatacaacttaattcttttgtgtgtgaccatctagttatacaagcaccatttgttgaaaagactatatttcccacattgaatggtcttggcatcctttgtcaaaaatcatttgtttatagatatatgggtttatctccagactctcacttctatttcattgacatatatatctatctttgtgcccatataccacactgtcttgattattgttgctttgtagcaagttttaaaatagggaaggataaatcctcttacttcattcttcttttttggtatagttcgagggaagtttacgttttaaatttgctgctattatgttacttaattttccccttattcttcactataaaagtgcaattccaagaatatttttattatttaaactttttgattaatcaaatttgagtgcacaagagttcaagttgtagttctgtatttttttccttcataggtttagcatttctgattgcagaatttcaaaaaatggctttattagcatcttttaatattttcattttactagattatttcctctagaaccaggctactcaagagcagggagacagagtttaagcccctgcaggtataaatcacttctctgcataagagggcactcaacaaatgtttccactagatttgttacccctatagggtatatttatagtgctcatgggaagcattttataaaattaaatgagaacaaaatactaaatacatttcggactccacctgttagctgtcctaattgtatatttttgggctttcttcatccacagttatctttcttttatgggatatatgaaacaaatgtttgactttcttattgtgacattattatatgtttgtattctatttcctgaaggctctacaaacatagttcttcacctatatatcttatgttccagatttctaggcagagacaaagtgtatgtaattttgtctgtattgcatcaaatagtgaccctgaataatttttacatgttgctgttagcagtgagcatgcaaagcttccttataagaaaatcattgggataatgaagagtaaatgattgaacatgaaccttttcttttcctttaagaaaaaaatagaagaaaatttagcttatttcttctaaagtaagagtggtatcttgagctagaatgtttgtgtatcaatgacgaacagtgctttttcttaagactggggcatgtattattcaggatatcgggacatcaaatgcacaacatttggagtctaaattctgcacttggttgtactactaaccaattgtgtgatctttgacaagtcccttcccgttcttagccttaatttctatctctaagtagagatggaaagaaggaatagggaacctctgtgatctcccctgattataaatctttatgattctgttgttctcttctagggttgccaaaaacacccaatggagaaaatgacctaaccctggattagtgactaggaatttgtttaacaactattctacaagcacctatgatccattggtgctttaaaattgtgacagcacagcaatgctcccctcaagggcaagtcaatcccatttaagtagatatgcataatgaattgctgtgagaaaacaagtgacagttttaattttaaaaacaacaacaataacaacaacaacaaaaaagcttacctgggcaccacctgcactttcccaaactgtgaagctctggaacagagtggtgccagtgacattatcccaaggtggctgaaatttagggtatacaaagagaccatacctaaaaagtgaaacagaatgaaattaagccaatttttatgtttctaactttctactttttcttgttgaaaaatacaaagtaaaagtaatgtattagggagaatgaaggtagatggaatctgtgaccctccccctaactgttcttgcctacccctcagccctcccacttttaccctctgtgacctgctcccgaatcccaacaaaatgcagattactccagagcccaagcctagcagcctcccaggggctctgcatatttggaagtttaattgctctctctattgaattatctctggccacaaaaggtacattctgtccttctgccttttcatgtgactctcttctctttaccatcgaactgttatgatctagaaaataatgctaacacaattatatacaaaagccaagacatagaggcagccaagatgtccatcaataggttaatggctggggaaaatgtggtgtatatttgcaatggaatattattcagcctttaaagagaaggaaatcctgccatttgtgacaatacagataaacctgggggacactgtgctgggtgaggtaagccagacacagaagggcaatagtacatcatatcatttaaatgagaaatctaaaatattcaaacttatagaagcagagagtagaatggtggttggcaggggctggaaggaggggaaaatgggaagtattagtcaaagggtacaaagtttcagctatgcaaaatgaataagtcctagagatatacagtatggcaaaatgccaaagtatagaatacagcaaaattaacaatactatattctatacttaaaaatttgctaagaggtcagattttgtgtcaaacgttcttacagtaataataataattcaaataaagaggctctggaggaaaacttttagaggtgatagatatgtttgtgacacagatggtgatgatggttgcaggggtgtatacttatctccaaactcatcaagttgcatacattaaatatggacagctttttgtatgtcaattatacctcaaaaaagcagtttcagaaaatgcacaggaacatcacccaatctccaacaaatgcccaaagtgctctcattgtgagcattctacagtaaaatgtgaaatcataagacagccaaaacatagatgaatttccccaaagttacctggtacaagaatgtgcaatgttctgagtgaaggaaagaagcggagcttgtgatgtttggttggtcatgagatggaaaaagtagccatagccagcaccacacactctgttcccctacagaaattaagaagagttaaaaaatagttaccccatgtatgataaggttgctggaaagaaagactcttgtttgtactcatcccaattttatattcactttctgccaaagtacattaaaactctattatagactcatttattctttttttttccttttgggaacaaaaatagtgatatggtttggatttgtccccctgcccatatctcaggttgaattgtaatccccagtattggaggtagggcctggtgggaggtgactggatcacggggtcagtttctcgtgaatggtttagcactgtccccccttagtactgtcctcaccatagtaagtgagttctcatgagatctggtagtttaaaagtgtacagcaccttgtggctcccaccttgtcttgcctctgttcctgccatgtaagttgcctgctcctgctttgccttctgccgtgagtaaaggctccctgagacctgagacctccccagaaattgatgcttccatgtttcctgtatagcctgcagaaccatgagccaattaaacctcttttctttataagttacccagcctcaggtatttctttatagcaatgcgagaatgaactaataaaaatattgtcattcttcttcctccagccagctcaactagactgcaatttgcccatcttaataactggtatctcatgctcaagcctctttctaagcttccacagtgagtttactcatgacatctaaaattctcctctttggtgaatgcaacagtatatggtagctctccaaggcaaaggtgtaccttgaagtcaagcctacacaatgtgttctctctggctctttgaacaactcaacgatttgtctattggctgaaggccacatgattggaccagtcatgacttagtaccaagacagggtgactgagtacaactacaactcaaatctcttcaaagtgctcttgtcctgaatagactattaagtcgccttgatatttctttataggtcttactatctaaataatttcatgtattttatgtgttcatataaaatctgacttctctctcttggaccatatgagtttggggatctaattctgatcaaactgaacacaatgaggttatctttataaattcaatgaagtacctacaatatgttcatccctatgtaacatagacttaagacaaattaaaaaactgacttcctaaaggtttaagactgtacacagatgtatttttttttggcctacccaatgttcatatttttttggttccaacatgttcaaaccaagagatttaataaaaaattcagactttcagcttttctgagcccaaattcctgtgaagtagccacaggtcaggtgaagataagaagggccttccttcttggactgtggatgatttttccacagtcctcacccttcctggttcactcatttatgatccctgcctagtctctgcagtatttgaatttgcaacctcaactacaggcaacaaagtaaataacatgttggctattctatgaaagtttctatttctgctttcctgaatcacatctgagttctctcagtgtcacacgctcacatcttaaggatcccaagccttctctttatcatcagggagaaagaactctgagaaaaatcggggccctatcaggctgctgcactgcagtgatgctattagtgggaggaacaaagggccaatcgatcaagctatgagactacttcctatgtgcccacgtgcatctgacctctctcagtctgagtggttgtccaaagtcaagatgcccatgtctacctggagaacagaagttaaggaataggctgctcaggtgtaagccctgtgctacatagatgaagggagtctccaaggctcccacatgattcaatcctgatcacctgggggttttccatggcctggctggtgcgagacaaggaatgtctggagtatcctccttggaagtcactcaatcccgggaacacaaactatggggcttggagagctcatcctgaacactggcattagggtcacagtaaagagaatggggagtcataaggaccatgacactgtgccactcaacaagacattaaatgcctttctttaaaaaacaatacttcagtgcagccctctatgcagggctcagtggggactacgctgtgagcatccccttggaacagtttcttaaactttcgtgtgcaacctggtagagttgtcatatttagcaaataaaaacacagaatgcccagtgaaatttaaatttcagataaaaaataaaatattttagtataagtgtgtcgcaaacactatctgaaatttaaatttgaccaaatatgctgtattttatctggcaggctttacctgggggtatattagccaaaggtttttagatattttgatttattaggggggtgatgaggaagggatgagggacagtattctttactcttggccatcacaaggtgctctgataggtctgctgcaggtgatattttgaccccattttgagaactacttctctacaggtgattgagagagtaacgctaagggttactaacgttcctaggagacattcaaagaggagagagacactagaaaaaccacttcctggtgaagttttttgccatgagttgctttgggaacccactgcaaatggaagccactgctgaaaactgaaggaggatagagacctagaaatcagggggagaatccattgccaggtacccagcaaaaatgctgcccagctcagtgcaagttatatttatggtggattttttttttcccttagaagtattttttttttaagtaatgatgagtagaataataacactcatagtgaaaatctacagagaaggcactacagtccaggtactggattttagagtctcatttatttttacaatagttttatgagttttgtattattattacagtttcatagcaaagaaactgaagctcagagatgttgagtaactttcccaaagtcacagagcaaatagttgtcagagccagctccatccaagtccaagtctggaaaagttagagactagagtagagaaatgaaggtaggacccaaaggcaggatgcccaataatagggtgcaagtgaagaaacataaacaagagagtacaaagaaaagtcttgtcacccggtcacggacagaacaggcatttgctgtggcctccccagtagtggagacaacatattgaacaacatcctttgcagaagtcaatgtatcatggacattcacgcaagggaaattccagagagaaattaactgtccaagtaagccagctcctagaggtgtgcatctatagtcaccagaaaaaaaaaaaaagtgaattaatccttaaggcaccggaggtagtgtttgatttctccaaatctggagagcatcttgcaggccagatttaactaaggagttgctcttttcacaccccaaatccagagaatgtaaaatccttctcattctcaccacatggggaaaaaagcatgcacagcttagcgtgcacagagagatacatgggtaggggtgtgggacatttctcaagagtaggaagaagacatgacattttgaagagtacatttaaggaggatgagggttctggaatttcagcattatggagatcaagtgttattaaggctgagacatgttgatgaggactggcttctgacacaggaattttgagcaatgacagatgaaaagactgagattatctgcagttgtcatctactatcagtgcagacagtagggctatggactgaatgcagacaagggttagaatttaatgaggaagttctgacccatccaaggacagggtcttgcactagcctttcacacagctcagggagttttactacattctcagtaaggatggattgagagtgaggactccatacccttttacttgtagctattctccatttctttatccttagactaagtaaactcatttcatcctatggcttcagtcattctagactaatatttttattgactttaatttccaaatgaaaggaaaacttcaggttttggggttttgtttttttgtttgtttgtttgttttcttttttgagatggagtttcactcttgttgcccaggctggagtgcaatggcacgatctcggctcaccgcaacctccacctcccggattcaagcgattctcctgccttagcctcctgagtagctgggattacaggcatgcaccaccatgcctggctaattttgtatttttagtagaaatggggtttctccatgttggtcaagctggtctcaaactcccgacctcaggtgatccgcccaccttggcctcccaaagtgctgggattataggcatgaggcaccgtgcccagccaactttaggtattattaagggtaactctctgaacatggctgatccactggcagtgataatatagcggcacccccaacaggagaagaacttaaagaccctattccttcctgaatgtaccacatgttccacaaggaacacacacacacacacacacacacacacacacacacattcagccaagcaaagacagtatgggggagaaaactgaaaaagattgctcttaacccaataacgcccaattccctgccttgtgtgacagaaagaaccaatgcctcaacccctggaggccttcagttttgggggaagtgtgagtcagggccagagttccccctgaaactagaagcctgaccagcaggcagcagccaggacctggtcagggaggccagcacatactgacacaattgccccgggctgtttatttagctttagcttcaattcactgtgggtcccaaaggttcttaccctgggtatttgtaaatagacagccatttcttcctcatttttcattcggttacaggatgttttgttcctttgtggactaattggccgagtcactcctgcacttcattattttggagtctgagcaattctccaatttcctaaaagcacttagaattctaatcacatgtctcacctaccacagggtgctcaccaaaagtgacttttggatatcactgaatattaagatgaatcactatcaaagatgccaacacgacttcaaagaatcaggtccatttctaagacttcaatggtcttagggtggcctagtctagagtggtggttgtcaatcagggatgactttgttccctacggaacatttaacagcctctggatacattttttattgtaacaacttggaggatgaagaagagagaagagggctactggtattcagtgcatagataccagggatgctgttatacagaggataggctcgacaacaaggaattacccagcccaaaatgtcaatattgacgtagttgagaaaccttggtctatagtctacactagagtcacatattagcaaaataacccacactcattttccagtatcccatctccaaattttgatggaaagacaagcctaaatatgaaaacatggttaattacaataagaatgctttaatagtctttactaggaaactattgatatcatttaaaaccattagatgaggcatcaggcattcccattaaaaaaacatttattagcattaaatcagctatctcaatttttctcttgtgctagaaaacagagtatgcactcctgcttcttggcctcaagaagaatcactgtctattagttggcaaatataagtgcccagtgtatctcttcagcccttgtaaatatacaaagaaataccacagctgttgttctcagtcacgattacacaacacaaactttccccagggaagtgaaactccaccttctctaggtgtgtctctctatatccacgagccttgggaaaggtcagcggtacataagaaccgagggccagagaagggggcttcttaaacacccaccttgtctgcaagtatacaatgagaaatgtggactggaagctaaaagtgatcatctcacttgtccacacagctctatttcattaccaaggaaatgctatttcattaccaagattttatgaggaaagaaaagattcttaaatttaaaaaatatattccaaggactgcatccttattcatcacctttgccagcacagatgctcagaaagcacgtgtttccctgaataaatgggtttgttgaatcatctgccctagtgccattagcatttatggcacatctgggtgatcacatataaacactttccaagcgcatttataggtgggcaggagactgcaactttggtcctctgttagctgataagactcacttttcttacaaaagaagcactttaacagtcagatcgcattccttcctggcccttcttactctcaactccaattgtgtatgctacaaatgattcatgaggaaaaaccacatatttatgcaggcagctggcagcttgcggggaaggtttaaggcaagcagggaattttgtgtggaaatcaattatttgcggaagtcaatgtattatggacattcaagcaagagaaattccagagagaaattaactgcccaagtaagccagctccttgaggtgtacatctatagtcactagaaaaaaagtgagttaacccttcaggcagctcttaaatatgcattacctattgagtggggaaagcttgagaactgaggttgggcctttaaacagaattccttacaaaattgattcacaaaccagaacaaattctcctcaaattaaatgcatgtctccaaagggctcttcttcagagtttttccacggactatcctaaacaggggtctggttataggaaatttccaacacctacataaacatgggagactctgagctctggaagtgaacagtcccttgctgtttgagagcaaagacttcccaaccagagagaatgagaacagattcacacaggttatgtcttctggaaagatgcagcctcttgacagataacaaggagctcctgtcaaagaagtcctagactccggagctggagctgctgagggaagacagcctgagggtgaagcgctctaagaagctacaggtgatacacaaaagaaccaccaccaacttgcttttggaaagcatggcaaacgcctatttaagaaatgtaccagggaatgccacaggcccctggagactcaagcacttatcacccatgggtcctcactggcaagaaggtacaaagctcaggttttgcttctcagtgaaactgccctggactcacctcagctgcaggctgggcagggagagaagcagaccacctgtgaacatcaaaactaaaaaagaatatcatatttgaaatttacttgcatcatgccaggttgaatgtaagtgaactagcaaggtgactgactgcaagcccagctgaattccttatgttgtggctgagagtttggtcccagctctgcatcagggcaatttgagaataatataaaaccacaaaccattgcacagacttaagaatcatttcccctgcctacctaccttccaggtcagagatttcaaggtcagactcaggtatgtgaggagagagagtttaggctttcagagttggttgcccaaacatgaagattaggccatcttcttcaagtctaaataaatacatttgtttaattaatactatcataccaatgtcaatgtcctggccttggtacagctccatgactatggttatcgttatgttatcattggagggagctagatgaagagcacataggaattctcttatttatgcagcttctcgtaagtctgaaattattttaaaattaaaagtttaaaataacaacaaagaaaaatcctaattaatcacaattttctatcacatctctttctgttccacatattatacacatacacacaaatacatgcacatacatacacacacaccttgttattgtggaagcctccttattatccctttggaataaaggtatatttctaaaatatgttcttcaaagtactctgtatatcatccatacaggacacaattaacactaactcagccaagaatggtggctcacacctgtaattccaatcctttgggaagccaaagtggggagatcacttgagaccaagagtttgagactcgcctagggaacacaggtttttttcacgtatacccagttaccacctatgtctttaagtaatggcacatcacagacaatagaatgcaaaaaaagactgaataacagaaagccaatggcacaactgaaaaactggactagactttgcaagatttaatgctgatagcccaacagaatctaaatgcttccactgactaaacttatttttcagtcatcaaaatgattttagaactttggaacttgttctttactttcctttttcttcccccacataatttggttataggtttataccttcattcgttatattaaatacatttttttttgagcaactaccatgttttagaaattgtgctagtgtctaaaggctaatgaaaatagaattagaactttaaggtcaccggaggagccaagatggccgaataggaacagctccggtctacagctcccagtgtgagcgacacagaagacaggcgatttctgcatttccatctgaggtaccgggttcatctcactagggagtgccagacagtgggcgcaggtcagtgggtgcgcccaccgtgcacaagccgaagcagggtgaggcattgcctcactcgggaagctcaaggggtcagggagttccctttcctagtcaaacaaaggggtgatggacggcacctggaaaatcgggtcactcccacccgaatactgcgcttttccgacgggcttaaaaaacggcacaccacaagattatatcccgcacctggctcggagggtcctatgcccacggagtctcgctgattgctagcacagcagtctgagatcaaactgcaagtcggtagccaggctggaggaggggcgcccaccattgcccaggctcgcttaggtaaacaaagcagcccggaagctcgaactgggtggagcccaccacagctcaaggaggcctgcctgcctctgtaggctccacctctgggggcagggcacagacaaacagacaacagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccaacaggggcacactgacacctcacacggcagggtactccaacagacctgcagctgagggtcctgtctgttaaaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgacgagctgagagaagaaggcttcagacgatcaaattactccaagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccatgcgatcaactggaagaaagggtatcagcgatggaagatgaagtgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatagagagaacgccacaaagatattcatcgagaagagcaactccaagacacataattgtcagattcaccaaagttgaaatgaagggaaaaatgttaagggcagccagagagaaaggtcgggttaccctcaaagggaagcccatcagactaacagcggatctcttggcagaaaccctacaagccagaagagtgtgggggccaatattcaacattcttaaagaaaagaattttcaacccagaatttcatatccagccaaacgaagcctcataagtgaaggagaaataaaatcctttacagacaagcaaatgctgagagattttgtcaccaccaggcctgccctaaaagagctcctgaaggaagcactaaacatggaatggaacaaccggtaccagccactgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaagaccattacataatggtaaacggatcaattcaacaagaagagttaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaattcagctctgcaccaagcgaacctaatagacatctacagaactctccacctcaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatggagacacaaaaaacccttcaaaaaattaatgaatccaggagctggttttttgaaaggatcaacaaaatagatagactgctagcaagactaataaagaaaaaaaagagagaagaatcaaatagacgcaataaaaaatgataaaggggatatcaccaccgatcccacagaaatacaaactaccatcagagaataccacaaacacctctacgcaaataaactagaaaatttagaagaaatggataaattcctgaacacatacactctccagagactaaaccaggaagaagttgaatctctgaatagaccaataacaggatctgaaattgtggcaataatcaatagcttaccaaccaaaaagagtccaggaccaggcagattcacagccgaattctaccagaggtacaaggaggaactggtaccattccttctgaaactattccaatccatagaaaaagagggaatcctccctaactcaatttatgaggccagcatcattctgatacctaagccgggcagagacacaaccaaaaaagagaactttacaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacagaattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacgaagtcaaattgtccctgtttacagaagacatgattgtatatctggaaagccccattgtctcagcccaaaatctccataacctgataagcaacttcagcaaagtctcaggatacaatatcaatgtacaaaaatcacaagcattcttatacaccaacaacagacaaacagagtgccaaatcatgagtgaactcccattcacaattgcttcaaagagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttacagattcagtgccatccccatcaagctaccaaggactttcttcacagaattggaaaaaaaactactttaaagttcatatggaaccaaaaaaagagcccgcatcgccaagtcaatcctaagccaaaagaacaaagctggaggcatcaccctacctgacttcaaactatactacaaggctacagtaaccaaaacagcatggtactggtaccaaaacagagatgtagatcaatggaacagaacagagccctcagaaataacgctgcatatctacaactatctgatctttgacaaacctgagaaaaacaagcaatggggaaaggattccctatttaataaatggtgctgggaaaattggctagccatatgtagaaagctgaaactggatcacttccttacaccttattcaaaaatcaattcaagatggattaaagacttaaatgatagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaccccatcaaaaagtgggtgaaggacatgaacagacacttctcaaaagaagacatttatggagccaaaaaacacataaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaaatcagtgtggtgattcctcagggatctagaactagaaataccatttgacccagccatcccattactgggtatataaacccaaaggactataaatcatgctgctataaagacacatgcacacgtatgtttattgcggcattagtcacaatagcaaagacttggaaccaacccaaatgtccaacaatgatagactgcatcaagaaaacgtggcacatatataccgtggaatactatgcagccataaaaaatgatgagttcatgtcctttgtagggacatggatgaaattggaaatcatcattctcagtaaactatcgcaagaacaaaaaaccaaacaccgcatattctcactcaaaggtgggaattgaacaatgagatcacatggacacaggaaggggaacatcacactctggggactgttgtggggtggggggagtggggaggaatagcactgggagatatacctagtgctagatgacaagttagtgggtacagcgcaccagcatggcacatgtatacatatgtaactaacatgcacaatgtgctcatgtaccctaaaacttaaagtataataataaaagaaaaaaaaacttaaaaaaaaaaaaaaagaactttaaggtcaccaaggataaatatgtcaggaatatacctaatgaatctacattaccagtttaacctaaaactccattctcaaaacatatgcattgtattttttttctaattttgtaaagcagatacaagagtaagaaagtaaatgaagggaaatggaaagcgttggagggagagcaagcagctagttgcagactcaatttttccattgctgactgggtattattctacaggtcattttgcaaaggctcacaccacccacagcttttcagattaccctctggttctctgcacctgcagccagctcaacccttcttcttgtcagccagtggccagcactccgtccagcagaccacatactacccagtgagacaaggacattccagcttcacacagcagggtgagctgggcaaccctgagggtttactttcctccaggcatttgatgtagtcaacattatgctacccagaaaagtacacaaaaacatggtttcttaagcccaaaagcttacagacatagaaagggcacataggaactcttttatttacgcagcttcttgtaagtctgaaattattttaaaattaaaagtttaaaataacaacaaaaaaatcctaattatcattaggatttttggcctgtagtgaccaacaagttaaatgcagctccagctgtcctggatctgggatctgggttcctacagtccgtgtagttctgcttcctttgcttactggcatattagccactcccattaggcacctaaaatggtgtgtgagtgctgtgcttggaacaaacataattaagaatctaaggaagaagagataaccactacttttactagggtttattcagctgaaggtaattaaaaacagatgatcagtgagaaagaagctcatcctctgagttccttagaaactcagcataatgacatagtggatgctgagaggagtttcctgaaacagtgaggcccttaactcctttgatagaagatccatgggataaaataattagaaaaggggaaatgaaatggcttgccactactctgatgcacttgttcactcaggtctacagctacattgtcccctcaaaaattaatttcttaaatgtttaaacagaaatgtgccaagggaaaccaatgttaagttgtactaaataatgggattttaaaaatcaaggttattgaagtggacttcatcctcctggaatctgacatgaccttatacacctcatgtctcagttttgaacactcttaaaggacaaaatatggccacattaacatagtaagatagtgaaggtttaaaaagaaattggtattggaatcaagtgagacaaaaatcagcacccagagttggtagttcagggagatattttagtttgcattacctagatgaccaggaaacgatcaatatctactttgttttgctccattacctattgcttcaaaaaagtgtttccagaaatcctgagaggaatgcttacatttatcctaaagtacttgtttaatgcaaaattataaattattttcttgatactaatatgcagcaagtaaacatttcataccacaccaccactaacgctgccaccttaaagaacttttggagcaagcttgtccaactggcagcccacaggtcgtatgcagcccaagatggctttgaatgtggccaaacacaaattcatcaactttcttaacacattatgagatttgttttacaattttttttcagctcatcagctgtcattagcgttagtgcattttatgtgtgacccaattcttccaatggcaattattcttccaatgtggcccagggaagccaaaaggttggacacccctgattgagaaagaactttatgccctctcagttctggtcttcctggtagagctgaacatcttacctctataacattggtgggactgcagatatagatgccagatggtgtcaacatttcaggattggagagtccctcggcaccagaaacctggatgatcacgttgtttcttattatatttccatgtcctgaccagtctaatgtttcaacaaatccaggggatccacaaacataattaaaatgtactcaactcaacacccttgattctactaatacacatcagagttcacataatgcatttcatatatatatatatatatatatatatatttagaaaatatttagtatgcacaataaacttaagagacctaacattttgccatcaggcttgtctataaaatatatgacaattttaaatacactgtaatagatttaaaatcaatttacatatttaccatctttccttccatgaattgcctcccaggagatatatctcatctccgtgcatgtccctgagaacaaaagaccccattacttgagtatattttatgtcacttaggaaaacaagagatgctgcaacactacttctttgggtgtgggttgttttgattttgtttttgtgtttttatctgtaaatcagggaaagagatacagatcttatgtactcttcagttctagagtatcaggaatcagaagttcattttaaataaaaagaacagaaaaatagatctgttttacttttgaggaggagtctaagtgactatctccactgttaagtgccacatatcctgtgtcaacaccaaccccattcctagctgttcaaactggccacctgctatctgcatgccctcaccttcccttggaagatctgaaatgtcctgtaggaacaggatggacaacatctaggaccttctcacccaaaccactgaggttggaatagaagagcaagcatgggccatgctaatagagaaattagtcacttaagggctatcaataaagagctgccccaaagaacccttcattacaaagtctttaagtatctaggcttcctcatgccatttcatgggtctgggtttgcatacttgttatgtgtgagattgagtgctttacccaccacacatcaataaacaaaaattttaattccctcacttgtaatacaatagatgtcaaaatcttataattcacaacattcaagcactaaaggctaaattctgcctacaggttttcttccttgcatagttaatatctattccacataattgttttctgctaaggtaatactgttaggatacctttctcaatttctccttgatgtttcaccttttcccttgcacggacaaacataggaacaaacaaagtcaatcctacatctgttagttgacttccctgtggctgtccttttctaatcaaaagatttttctgcacctgatcacctcagttacccttagtttttgtcttttagagctagagtatgttttaaagcaaatgtatctgattcacattttctcactagacagtttccatctcaggatagaacttttatagcttttatctcaacagattgttcttaaatgaaacatgtatttttcccactgatgatactatagaattaaatatcaaacggtatttaacaaatacagttatattctcactttcagtgaaaacctctgatttgcttttttattctgataaaactggagaccctttgtttcttaattcattcatttctttcaactaatagatctacaatgcactagttaatatgctaagtgttcaggagacaatgtcctcaagaaatccggtggtataaagacattaatcagatgaccagaaatgtggtatataattttaaatcaagaagtactgattggcgcttaaagagcttaaacagaaggacttgtctgggagagagaatgttgcaagagaagagtaagtggcatgaacagagccagagagcttgtgcaaagaccctgaggaaggaaaaagtgtggtcttttgaaggaactaaaataaaatattttaatgtcactagagtatggagaaagagaaaaaaaacaagacaagtttacagaagttaacagagacaaaatcactgaagggatcttttaagtctggtgaaaagtttgggattctattttaaaagcaataagaatctcaaaggagagaagtgatatgatgcaatctgagatttttaaggataattctgagttttgcaaggggaatgaactttaggaaacagaagtagatagagttgatcagttgaagattctgaaacatgggcttcttcagcaagccacaggagcttgaattctattaagaagagaattccagatttttaaatccttggccaacatccaagtttgacagtctgtaagactatacaaagacatatgcatgtgacttagaattattgtgaaaattactggtagtaaactttaaaacttcccattatacacttattaacctgaactaacctttaaaagatcagtatcctataggtaaagtttagtaagccaatcagtgatgactacatttaaatttagaatgttttactgtagcccatttctagtgatcataaagccaatatttttataaattaggaattagaaatttggggagaattcattgtgaaaaactgtgtcctacacaagaatgcagaaattcaacaagcttgttttacttaccaactagcagcgcatgacctaaaatattgtagaatacattactgtccaccttcaggcccaaggtcccgcacatgctgaggcctctactgaaggagttcctcactgtgcagccctgtatgaaagactctgaataggaaagagtaaagtaaaaattagatatggctcctgagattctgttgaccatatttagagcaacctacactgtagctaaagacattctcccacacaataatgaaactcaggagataagaagttagaagcagcaatcgaatcaagagaatgagtaactcaaaccaatgggcctcaataataaaaagggtgaaattcaacaatcaagtgttagaaaaaaaaaaacaatctgagaaagacaaagtatgtctaaacaataaaagaactcatggctgtcaagatttccaactggctatcatctttagtatcagctttcatcataatacagcagatgagaagttaaggataacgtgaagagcactgcttatgggccagccttgatctttgaaacctggagcagtgaattaatatttataatttatcaggcaataatattcttggcccaagatagccagagactcattcctaactgtaagcaaggtcaaaggttggcctgaggatcatgactctcacatttgaactggataggtttatacaactaaagaggaagctatcctctactacgctaaaaaattgacaattaggaaaatcattacactggttccataggcatattctatgatccccagatctggttacgaggcctagatgagtcaatgaatacacaattactgagtatcaactatatgtttcaggaattgtgcattgcattgtgctggaaacataaagatgaatgaaactaagtaacctctgcattcatgtatttgcattctgatggaggaaactgacattaaaataataaaaatccattatttgaataattaaactataaatcctaaaaagggagctttgtattattactaggtagtgagaaagatacagatgccaagtgctgggatattagaaaagttactttagtttacagaataatttgacttttacagttgggactatccaaaaaattctaaactttaacatcactatcaacactggatctccacattcccctcaatctcagctctcctactactaggtgccctcacattgctcatcaaggatccaccccaataaattaacccatccatatctacttctgtagcaaacactgcccatagtgcacagaatcttcaccatatcacccaaacagcataggcctgaccatgtgaaaaaccagtaagtacttatgtgtttgtgtagctcttatgggcggaatactgggattagtgaacctttaaaaagtactgtgcaacatttacctatgtaacaaacctgcacatcctgcacatgtaccctagaacttaaaattaaattaaattttttaaaaagtactgttcaaatatcccaatgctttctaactctggtagctgggagtaattagctgcgtaggacatgaggggcttcagggtgttaaacaataaaagattccttaatgagcattccaaaagtttctagcctctgcattttaacagggatttaaaggtaataaatgtattaatgcagtaattttcaaacttttattttttaagcactgaactctttttcaaataaaacctaaaatataaaatatctataaaaatagatgagtgtgcagctactctgattgaaacagaggtgggagagataggttaggtaaaatttgatcaaggaagggctttgattatgttcaattgataacttatttgtgacagctaccctcttttttactgaattggccgcatgtcaaatattctgcagtactatatacagctgaccaaagaaccagagagaaggaaataaagatactaatcaatccgaagcactagcggagaggccatatgcggagccatcctctgaaatgactcaaataaatttaaaaagattggaaaaattagaagaaatagacgtccttagcatgcagataatttgaaatgaaggaaaatgttgcttctggcagttcagaatcctgccctcaatgacctgaaggattactctgcaattacctgttagaatcctagcatctctcaaaagccacctgaaccacaaagtatgccctgatgtcctttgtcaggcatcaacctctgaacccctggggcacagcctctttaaagaaggcaaagcttgaatgtgtgggtgttgaaagtgctgatgaatggggaggattactcagaaatggagctgctgtcctcctgacttggcatctgcacccccattctgtgattctctgcatgtcagcttttggtaatgagtttttgccctggatgttcctacattcaacttttattttagaacttttatcagtgcatttggtcatattctgtttttctgattctgatcttgtttttcacctagttgttctcacctgaatttgatgtttcctgctcccttcttatatcttcatgtctggccaagatctgcacatgtaactgctcctcatttccagaaaaagcacctgggtttcagcccattccccctcatttccccaggcaaaagattcctctgatttaggacaactttacatagaagtgcctggactcccacagtgttgataatgtaatgccaattcacctgtagtcacaaagctagtaagtggtagagacagaattcaaaacacaggattgtgtggttcactcttgtgtgctgtattatagtgatagttctcaaactggactccttggactgcctgttccagaatcaaaaggtttgtatttaaaatacacattcctaagcctaccttagaccagaatttgttggggtaaggtctataactctgaattttaataagctccacaagtgatttgtttaggcatactgaagtttgggaaccatagacctagaatataacaattatccatctctaaatccctcaaatcccacatatcatctatcattccaccatgcatgtagtgccttaaacatgggagaaagaaacatgagaaagtcctaggtccggacccccttacctctcatagctcccaccagagtgagtgagctcagatgcttatggaaggcttgccccaagacttgaaactgcactcccttcaactggacctggctgggctcttctgggaaggactgaacgatcactctggctcccatatccctggatcctagcatcttctcactcatggaatacaaacagtgctgcagattacctgaaatgcaaaataaagtccagagaacctaaagcatgtagaacatgcttccagacaaatctcccagtttgaaaggtactgtcagcaccgaggaaaaaccattactgtttatttcatttaataatcttatttccccttttctttgattctcctctgtatattattaattaaaagatctgataaacaggacatgatgttgccttcattctattttttcaagaaactcccaaatcaatcaccttaattactgtcacaaagagtcagactataacccacaaacccaacctaaatagatgcttatttcaatctaaaagatcctctggaggaaatgtgcaataaaatgaccttcttgtggttgataattgtaggaaagacatgttagcactgaatataataacagcactttttaatcttaagctgtccaatgaggtttccccattactgtgctgttttatggtttggggacttagcaataacgctaccacagaaatgtcaaaggactccagagaagcaactgagcagctcctgcaccaacacctacttccccagctgtgccactaatgaggacagcagcaacctgagcctaacacacacaactacaaatgccagtgaggacagcaaccacctgaactaacacacacaactatgaatgccagggagggcagcaaaccacctggacctaacacacacaactactattgctaccaaaatgttgtgacctcaggatccagggcaccttctgttgatacatggcatttggtggtacaaactaatctggagaataaatcatctctccaatggataataaagatttttcatgttaatgatccaaagaagcaccaataatataaaacactgtatcatatcacagtaaatttcagaatccaatcatttgctattacccagagaagaggtgaatgaagagatatttatatttgtatgccttatcacaatttgattatttgtgccactgatccataagattttcaaatggacaggccttgtgttattaaattcagctaccttgttccacactccagccccacacagaaaagaaatgacttattttgagaatattgtagttgtatttacgatttgtgatgcaatcaaggatgttttccatttggggctaacagatttataatggcttaaacctagaagcatgatctcactggcagcatgatcaaatgcaatatttggcaaaatatgatctcagaataccaaggaagtttgaatagaatgtagatcccaattctgcagaattgataaagttgggcagttgatggaagtgaacccactgttatccaaacattctttttagaatgacacatttgtgagtagatgatttgtagggagggaggtgaggccaaactgcctctctacttctaacaactccccacacccaaccacatggcaacattttactcacatgcacctatatttagacacaactcaaatctttaactccagctccctttgacctttcttccaggctccacacattaccagacatctctacacagttggctggcctgctggcatctcagttatgacatatacaaaattaaactcacgattgccactctcccaccccaaaacctgctcctcttcccatcccagcaaatagcctcatcatccatccagagctcatgcctggaagtcatccttgacacccacgccatcctggaccaaagttgacaaatgatgtcttcacaacatgtgaaagcctcataatctacagcctgggaaaccaaaacatgacctactaaactaaccatccctgaaatagatgcttaataggcacatcaatgtgattcagtgcctgctattctactagaagataaattgaatttttccaccacttacctaaagtatgtggtagttcactcagaaaacaaatcccaaaatggggatgggggagccctacaagtctaatcagtaagaatgtgctgcctgagcccagaactctggcatatggctttcctgagaatcttagaagtggcctggaattttaacattgaacccagaaatgtaattcaactcttcagatttagttctttaatagaaatattttccccagagaaataatattttatttcttttgtcttttgttatctttttcacaaggttgttgggcagtggggcagagaggaggatgaaatgacaatcaagagcattctgaaaactacagaaaagtatgggcatccaaagtttaagggcttattctattttaaaagaggtcaaccacagcaatgccatctatcatcagacagtaagaatattcttttttgctcattagactttccaacaaaacactcttctaccttctggagcattggcctcctggcatgaaacaagcagcttctccctctcattagtgagatttccttgtatggtaatactcctgctgagcagagccacagtggcctttaaaatatggtgctctccagccacccaattctctgtaaagttgtgagaatatctggagaaaaaaagaggatgatagaactgaggacatcactccaaatcttactaggaataataagccactagattaacataattcttcctttggggatctattcatgtttctttagaaactcaataccaaatagtgaactatagacacaagtacatgaaaattagaaactatgctgatcattgccccaaacatttgtgtaagacagaagttctagagacaagacaaactaacttacaaagtctaaatcttcaaaacatttcatgctttttaattttcttgtcaaaatgtctaccattatttaagcagaagaaatatatcattgaaagaccccaatacaaatgtccagaccccaatacagttaagatctcatcttcttccatgtcaacttagccaagctgacactcagtacctcaaaggtgacttaagatagaggtctgtatcctgcacagtttccacagtgacaatctcttccatcggtttggcacctttaacacctgttccactgatgatgacaacttcatccccagggttccagtccacagcatcttctaaagccagcactgtgtctagggcatgggcagttgctctaagacaggtgacaattacttctggtagtgaacctaaagcagcccgaggaaaagttgtccagataatttaatcattaatcaaaacgtgattaatttaatcattaataaatgtgatgttatttagccaaagaatcccataaaataagacctggaaaagcaagcttcaggataggtaagcactaatttttttatattagttttgttttattttgtttgaccttggttttctttttatctataaaaagaagtcaataaaagtaagccagactagagaatagcaacgtgtaaaaagcacaagaattgtggtcagattacacttatatttgaatcacgatcttttcatattctaaccctattctttagggtaataaacttgatgaatgggcttcagtttcctcagttaaaaacagaagtagcagggtcttccatcatagggttttggaaggattcaatgaaatagtatctatgaaacatctagcttggatcttaccacataatagaccctaagggtatgttagtcctttctcttccttttctgtgtcacactgtttgaggatgaaattttaccacctcttttttattccaagaaaaaacaagtggttattagactttctgatgtagacctccataactaatttccaatatgaagacttcacaaataacaaaaatagaggggaaaacaaaaattatctcttagagttgtcataagtcttggtgtattaaatgatcccttcaaactctaaaaactagacctatctaacataggactgctaaatgcagttgaagaaggggaacttgtggttcaagataaactttgtttgtattacactccagcatacccgcctgaccatccccataccagcatgctaatctctaattatcaaagattcaagaaggtcatctgtctcacagtttattctggtcttttccagcaagggtcaaggcacagattttttcaaggcattatctgaatacttcagaaaacacatggcttactccctactccttcctctttctgtagtacatttccttcctcttttgcaatggatgataatttacctttagcccgcagcaagttactgtcctcccttgttgtactaaagtaaagtaataatacttgaatctctaactacagaggtggccgacaataaatcattttcaaattattttaaactttcctctttatttatttgtctctctgtgcataagcacttgtaccaataatgttctaggtttagaaaggtctctgggttaatattgtaatttctgaagtttacttgggcaataattttgtcttaaaaaaatgtacagagttcaaaatttctaattataaggcaggtgaaaattaagacataaatcatcccaaaagaaaataattttaactttatttcttgtttgtatatcttaacccttggaaacaataaaatgaaataaaatttatttatatgtatatgcatatatatgtgaatttttataacccattcttgaatgcctacatagaaaaatctctactaagcacagaaaaatgtttatccaagacaaaatgccgtcagactctgtgatcagtattcacaattctcaattaatatgcaacaaatacctgctatgtgactatcaacatgcaagctacgcatggcagaaccaagagtaaagaccacaaaggtctagctcaactagttactcctataaataatggtcaactctgaatggatgaaaaaattcacagataatctttgaagtacatttttaaactattaacaaaaaagttacatctttgtaaatattgacagagcctctagaaagcagtaaaactagcttataacttatgcactcccattgcaaaaataacacctctatgtgtatggttaaaacatcaagcctggatgtttaatgagtgttggcctcatatttctagctacatagtagatattgacatttagatgagctactaccatcttgaaattattgtaataattatctgagctagaccctcttgcaaacagcttttattcctttaagtattcctccttatgttctttttttaaacaaattttgtgctaagttatttcaattacatcccttctttgtccattaacctgcagtattttcctgcaatactcagtaacaaagtctcaaatttgctgcttgacttcaaagactctccataatgtgaccctactttatggtctctgatttcttaataaattctgttccaagaagcccagtctctttacctcttctcatttaaccggatcgtcctgcctctaatcttttgtcaatttcgtcctttccgctcatgtccttgcttctttctcttcatctatccttttaaagcacaactcaagcccaatcttttcagtgaatttcagaacatacttcatcttcacttcctcctacaaaccttgtagtgatcagtgacatcgttccttcagcaaaatctgtgtgtacatctgggatttaggcattcccaagtatgtctgggtagcttgtgggccatttatttgagctgctttgtgtgggggaggaagtttgcacaaagaaacagatgagagaaaagaagatgacagagaagatatggggtcaatctcagatataggccctctctcttgaccacaaggacctatgactgaacctgagggaataatttggaggaaccctccagatggctttgtcacctgatgctgctccacctgagattctctcaccaactcactctgctgcattctttagaacttaatcctgagagaaggctccaagacttgctgagtaggcaaaccctgtatataatctgtcatatcaccatggctgtctcctttctcacacttaacacaactgcaatttggcctctatttctgtacttagaatttgtctcccccactaaacataacagcaaaaaccatacctatgttcattcaccgtcacaatatcaatgcctttcacagtgtctagcatgtaagtgttccataaatacatcctgaatgcataaaatcacaaatgagacagagaaacaagcaccccaatgtcttggtgtccagttgatcagatgggactctgagtggcatgcagagacagttgccacatttcatcatgggacacagtacactcccacatcttggggttttaaatgaaagcccacaccctcaaacccatgtgttcagtactctcatggcaggtaccagcagtagatgcagggatgaggcagcccctactaccttcctaaatggagaacaatgaccaagaagccaaagtaggaggaaaagaacatgaaagatgcctcatggtgactaaggcagacagatgaactcacagaaaacacattgtgagaacacgtagaacaagcaagcagaactgctaaaaaggggagaaggttttgtgagagttgggggcctcagacagtaaaatttttatcactattgaaatatccacaggctgagcaggctcagggaagcctggggagacttcaattacataaacaatagtcagtcccatgtatctcagcactaaatcatcctgaaattactaaagtgcatgtgtcttttctctccaccttacaggtggcaccatgactgctgtgccactgcctcatgtctcctttatatatggcacaattcctaacacagcactggacgcataattaacattcaattcatagtggtttaaatgacctattttaagtattgccttctgggcaatcacttgtaaactcccatcagatatatacccaagtgagtatataatattcaatatgcaaaaagcagaaaaaaatacaaacatttattgaaaacttagaataaccccaacctatgcaaactagtttcattgtcaagtaagaaatctttggttttttatttttgttatttattttaacagattgtacagataggaaactatgattcttcaaggacaagattatatggtaatagatatcagcacaaagttctgaaactagttcttctgaatctaagaccagagaactagacaagtaaatggaatttgtagcctctggaaatagctgtaaattaactgtacccaattagctttgatgttcaaaaaattatactcattacttcataaatgttatttaaatgtcatacaaggtggaccaactgacttctctgatgaagaaggcattgcacacattttacatctgagtcatttctgttcatagaactattgaaacccaggttgggtagctcccttcctttctgtaccacaaatcaaaaacacataaaactacgcataaaaagctcaataatttatgaatatgctaaatgaaaaaggactatgcttttaacttgtaatttaatactatgtttaatcactttgggctttccatgttgacctgttaaccaacaaactactcatttactcccactaatgacttctactcataattgtatttcctacaaattattgttcaagcatttcaatgtcattcatccataattacacagtctcagagcaccattcttactaaatgggcatggagaaaaataaaataatccttgtgggttaacacactaaaatcactaattgtcctctgtttgcttactttgtaggacttaaatctttattctaagaataactgccaaggcctttcaaaatcatttagggtgggggagggagagagggagagagggagaggtgggggggagagagagagagagagagagaaaggagaaagaaaaggataatttattaaaataatgtttgcatcagaataaaggaacttacaaaaaaaactagaaatattgtcctcaaatatatacaaattatttcccccttatttctggatgcaacatcaccattatccatagcaaaacattagatgctgtcttgtatgtggatgaacatttgtcacgcactaggaagacaaacacaaagaacagagtccctttcctccagggcccatgatcagtacaagaaatagacaaaaatcagaagtgcactgtgcaaggtgcagtgacactcaggggtgtacagacatggagcactgcaatcacaccaagggagtggtcctttccaggaatgcttcccagaagaggtgataactgagctgggtcttgaaggacaaaccaaagtgtgccagatgacaaaatgggaagcgtaccctaggcaacgacaatgatgtgtaagatggtgggggacattcgaataactgctacatatgtggcatggccagagtacaggtatacagaaggtataggcacctagtgactgtcccttcattctgaagaggtgagcaggacccatccaaaaatgactcacaggccctcccatagcacttagagtttatcctaaaaattatttggaaaccactaaatgaatatttgggatgaaatctaagaaatgatactgttgtgaaactgttttaagcccatagtacacatatcaaactaagagaagaaaatccttagtgagaaaatggacttactgtatgttggggaaaatgagtcaaatcctaagacaaacaagagccagccagtagggaaactgagagcctgatgtgttactctatgaactagatatcagacctttggagcaaatgaagaggactgggcaaaataatgcaggactttgttgacctgttttaaagaccttaagttgtatttgaaatagttataaaaacaaatatatacatatatatattcattatttatttttatatatttatttttaagttctgggatacatgcgcagaacgtgcaggtttgttacataggtatacacgtgccatggtggtttgctgcacccatcaacccatcatctacattaggtatttctcctaatgctctctttccccttgccccccacccactaacaggccctggtgtgtgatgttgccctccctgtgtccatgtgttgtcattgttcaactcctgcttatgagtgagaacatgtgtttgattttctgtcttgtgttagtttgctgagaatgatggtttccagcttcatccatgtccctgcaaaggacatgaactcatccttttttatggctgcatagtattccacagtatagatgtgccgcattttctttatccagtctatcattgatgggcatttgggttggttccaagtctttgctattgtgaacagtgattcaataaacatacgtgtgcatgtgtctttatggttgaatgatttataatcctttgggtatatacccagtaatgggattgctgggtcaaatggtatttctggttcctgatccttgaggaatcaccacactatcttccagtgtaaaagtgtttctatttctacacatccactccagcatctgttatttcctgactttttaatgatcaccattctcactggtgtgagatggtatattgaccagtaatgatgagcttttattcatatgtttgttgatcgcataaatatcttcctttgagaagtgtctattcatatccttcgcccactttttgatggggttgttttttcttgtaaatttgtctaagttccttgtagactctggaaattagccctttgtcagatggatagattgcaaatattttctcccattctgtaggttgcctgttcactctcatgatagtttcttttgctatacagaagctctttagtttaattagatcccatttgtcaattttggcttctgttgccattgcttttgatgttttagtcatgaagtccttgcccatgcctacgtcctgaatggtattgcctaggtttttttctagggtttttatggttttaggtctaacatttaagactttaatcaaacttgaattaatttttgtataaggtgtaaggaagggatccaatttcagctttctacatatggctagccagttttcccagcaccatttattaaatagggaatcctttccccattgcttgtttctgtcaggtttgtcaaagatcagatggttgtagatgtgtggtattatttctgagggctctgttctgttccattggtctatatctctgttttggtacaagtaccatgctgttttggttactgttgccttgtaatatcgtttgaagtcaggtagcatgatgcctccagctttgttcttttggcttaggattgtcttggaaatgcaggctcttttttggttccacgtgaactttaaagaagttttttccaattctgtgaagaaagtccttggtagcttgatggggatggcattgaatctataacttaccttgggcagtatggccattttcacgatattgattcttcctatccatgagcatggaatgttcttccatttgtttgtgtcctctttgatttccttgagcagtggggtttgtagttctccttgaagaggtccttcacatcccttgtaagttggattcctaggtattttattctctttgaagcaattgtgaatgggagttcactcatgatttggttctttgtctgttattggtgtataagaatgcttgtgattttgcacactgattttgtatcctgagattttgctgaagttgcttatcagcttaaggagattctgggctgagaggattgggttttctaaatatacaatcatgtaatttgcaaacagggacaatttgacttcctcttttcctaattgaataccctttatttctttatcctgcctgatggcccaggccagaacttccaacactatgttgaataggcgtggtgagagagggcatccctgtcttgtgccagttttcaaagggaatgcttctggtttctgcccattcagtatgatattggctgtgggtttgtcatagatagctcttatgagtttgacatacatcccgtcaatacctagtttattcagagtttttagatgaagggctgttgaattttgtcgaaggccttttctgcatctattgagataatcatgtggtttttgtctttggttcggtttatatgctggattacatttattgatttgcgtatattgaaccagccttgcatcccaggtatgaagcccacttgatcttggtggataagctttttgatgtgctgctggatttggtttgccagtattttattgaggatttttgcatcaatgtttatcagggatattggtctaaaattctcttttttggttgtgtctctgccaggctttggtatcagaatgatgctggataaaatgagttagggaggattccctctttttctattgattggaatagtttcagaaggaatggtatcagctgctctttgtacctctggtagaattcggctgtgaatccgtctggtcctggactttttttggttggtaagctattaattattgcctcaatttcagatcctgttattggtctattcagggattcaacttcttcctggtttagtcttgggagggtgtatgtgtccaggaatttatccatttcttctatattttccattttatttgtgtagaggtgtttatagtattctctgatggttgtttatatttctgtgggataggtggtggtatcccctttatcattttttattgtgtctatttgattcttctctcttttcttctctattagtcttgctagtggtctatcaattttgttaatcttttcaaaaaaccagctcctggattcattgattttttgaagggttttttgtgtctctatctccttcagttttcctctgatcttagtgatttcttgccttctgctagcttttgaatgtgtttgctgttgcttctctagttcttttaattgtgatgttagagtatcgattttaggtctttcctgctttctcttgtgggcaattagtgcgataaattataatttagtgctataaagatctgttgttagtctgatgggcttccctttgtgggtaaccagacctttctctctggctgcccttaacattttttccttcatttcaactttggtgaatctgacaattatgtgtcttggggttgctcttctcaaggagtatctttgtggcattctctgtatttcctgaatttgaatgttggcctgccttgctaggttggggaaattctcctggataatatcctgaagagtgttttccaacttggttcccttctccccgtcactttcaggtacaccaatcagacgtagatttggtcttttcacatagtcccatatttcttggaggctttgttcatttcttttaactcttttttctctaaacttctcttctcacttcatatcattcgtttcatcttcaatcactgataccctttcttccacttgattaaatcggctactgaagcttgtgcatgcatcacatagttctcatgccatggttttcagctccatcaggtcatctaaggtcttctctatgctgtttattctagttagccattcatctaatcttttttcaaggtttgtagcttctttgtgagggattcgaacatcctcctttagcttggagaggtttgttattaccgatcttctgaagcctacttctgtcaactcatcaaagtcattctccatccagctttgttctattgctggcaaggagctgcgatcttttggaggagaagaggcactctgatttttagaattttcagcttttctgctctggtttctccccatctttgtggttttatctacctttggtctttgatgatggtgaccaacagatggggttttggtgtggatgtcttttttgttgatgttgatgctgttcctttctgttagttttccttctatcagtcaggaccctcagctgcaggtctattggagtttgctggaggtccactccagaccctgtttgcctgggtatcaccagcagaggctgaagaacagcaaatattgcagaacagcaaatgttgctgcctgatccttcttctggaagcttcatctcagaggggcacccagctgtatgaggtgtcagccagcccctactgggaggtgtctcccatttaggctactcagggtcagggacccacttgagtctgtccattctcagatttcaaactctgtgctgggagaaccactactctcttcaaagctgtcagacagggacatttaagtctgcagaagtttctgctgccttttgttcagctatgccctgccccgagaggtagagtctacagaggcaggcaggcctagctgagctgcggtgggctccactcagttcgagtttcctggccactttgtttacctactcaagcctcagcaatggcggatgcccctccccaagcctcgctgcctccttgcgtttgatctcagacagctgtgctagcagtgagcaaggatccatgggcatgggaccctccgagccaggcacgggatataatctcctggtgtgccattttctaagaccattggaaaagtgcagcactagggtgggagtgtcccgattttccaggtaccatctgtcatggcttcccttggctaggaaagggaattccacaaccccctgcacttccctggtgaggcaatgccccaccctgcttcggctcacactccatgggctgcatccactgtccaacaagtcccattgagatgaacccagtacctcagttggaaatgcagaaatcacccatcttctgcgttgctcatgctgggagctatagactggagttgttcctattcagccatcttggaacccaaccccgttttgccaaatttttaaggtaacgttcatgggttccaaggattaggacatggacatacatgggtgtcattttttagcctatggttgaataaatagtgctgtgaaaattggctattcatttgaaaaaaaatagataactgacaaactatatcagaatcaattctagactgattaaaataagggcctggtaactttttctgtaaaaagaacagggagataataaagagtttggggtttgcagaccacgtggtctctgtcataatgactgaactttgcccttatagtgcaaagcagccatagataatacctacacaaatgggtgtggctgtgcctcaataaaattttgtgtataaaagcaaggaatggaccagatttggtccatggctcatagtttgctgaccctagttaaagacagacacaaatgtgaaaaaaaagaaaaaaaaaaaacaataaaagtaccaaaaaacaagtaggtaaatttttatatagtctttgtacagaaaagagttgataaacataaaatcaaaggcagaaaccataagagaaaatatttgtagatttgccatcacaaagattggaaaactccatagaagtactaaaagataaataacgtgtgaaagaaaccggttctttgtacctctatcaagaattttacaaagagagctataagccagaaagccccaattgggatctcaaaataagctgaaaaagttaaaattgaggagactgtttcagaaagaagtatattctgcctttctgccacaagtaaataccagctatgtgtacacaaaatagaagcgaggccatgtgtgtcttaagtccaatgaagaaaatggaatgagttttagttacatccccttgcaggccccagtttcatcatctctaaaatgaaagtaacgatcccagtctttcaggcttcacagggtggttgtgagagttaaatgagagtaaagaatgggaagcagctttgaaaattataaagtgccaggatctaggtaaaatccaattttgacaaataccaaatataatacccaattcaatgatactctttttccatgaccaggctgaaagcaatactattaatagtattgctttgatgatgcatatggaagaattctctttgaaggaaaaatcacaagcttctgcctatgtagctttccatttacttaacaaagttgagtttcttgtggtactcaaaaatgtaaaaaatgaaaatctacaccacattaaccatttagtaacctaaaagaagactactactgaagcatgagggtggccaagggggagagttgaaaaacaggacagaaggtgttagcaggaagctaaatagcacctaatagccatgctataaatttcggactttaccttagaaacaacggaaagccactgaagagttttgagcagcagcacaatataaacagatttgtgtttttaaaagatcaacttggctccagggcaaagaatgaattggaaagaacagaagtggcaactagaaagtaagtttaaaagcttacacaataatccaggcataagttgaaggtaccataaactaaggtgacagtaatggagatagagagaaggatatgggctcacaagttatctaagaattaaaatcaacaagacttagtgatggacatgataagaggaatgataaaggaggtatcaagaatgacaaccaggtttctagctgagagattattggaaaacggtaaacaccatcccatctttagactaataatgggacaacttcaccaaatcaaaagtgtaaacaaataataacaatgataataactgacatttattgagtacttgctcaacatctgccattgtggtaagtacattacatgttttgtttcatttaaaccacataacaaatatcatgagaaatgtcttaaaataatgtccgttttatagatgtgggaactgaaacactggggagttttttaaggtccactagctagttcacggtagagatgggatttggaccacgcagtccacttcaagagcccaggctcctcatacttactcagaggaagatgagtgagtgagtactctatgacggagcaaagtcaagctcatctagagaagatgcagaacgccagcaaagatcctcacaacctagcaggaaaatggaaactacagaaagtttgaaaggaagagatgaaccttggagctagttactttcctttgagaagctttgtgtcaagatgagaggcttgaaatcctcgtgtgtctaaaatacgatacagagtcagttatgaggtttgctttggtgactgtgatggttaattttgcgcatcaacttgactgggctatggggtacccacaactttagctaaatgtaaattgttcttcgtgtgtgtgtgtgtgtatgtgtgtgtgtgtgtgtgtgtgtgtaggtatttctaacgtaattaacatctgaatcagtagactaagtaaagaagattgccttccttaatgtagatgagccttatccaatcagctgaaggcctgaatagaacaaaaaggctgagtatgaagtaacttgaactgagacattggtcttatctggtcttcaaacttagactgaagcataggttcttcttggatatccagcttgctggccttctgactggaacttacaccattggtcttcctggttcttacgcctttggacttggactctctatctgcttctctttttctctccctccttctctctcccttcctctctctctttttatctctctctctctttttatctctctctctctctcaaatggcttatgactcaaatggggcgaaagttaatcctgaggcttttgctcaagtttttcattcacttattcaagcaaatattttttaaagcatattatgagtccaggcactgttctaggcaatgcagattaaaaaaaaaaaaaaagtaaagtgcttgccctcatgatgtatatattcttctgggagaggtaataaaataaatacaaaaaaatgtgaaaagtaaaccttacataatacattaaataatgttgaaagctaaggagaagaaaaccgaaggagcaatgtcaaacggtgatggggaaatgttgaaatttgctcagaagttaaacagccattgggaaagaggcattccctttcatctggagtcacaggactgccatttctgcctccatgagggcagagtttgactgaaaatgaagccagctgaggggaaagcagaaccaagagtcgcagagaaacaaaatcttaatgacttcattggagcacctggactcagctgtgcctcaagttttttcttttcgcctcaagttttttattttcagttatatgaggcaataagtgctcttattttttgttcgaattgggttttctgtcacttgaaaccaaaaaaagacctgactaatgccgacactttcaagtatatatagaaacttgaagtaccttacaatgtgtttctaagtggggttcctgctgtacttggattattgaatagctagaactcatttctaattagcagtatacatttacatgcaaacacctgaaattaaaagaccttaaaaacagcatgttcacttaaatgtgtttaaacaagtcccctaaagtgtggtttatactattaatttaaggaaccctttcttaaagattgttccaaggttactcttgtccagatcaatgagattttagcagacacatatctgccactgtaaatagaatggttatacagtgtttagacttttttgaagtattgttagacagaacagaaaaaaaaccttattttttgttggtggtgttggttatattttagaggacatagagccaagggtcagtctccatctgctcaaaagagagaaacactcatcagtcactggctgtcctaccacgctagggttccaagtatgccaggaccatgcttgctgatgttaactcaactgtgtaattacgatctgccacaacatgccagctgaccagaaccccaacactgaattaaagctcatttaaatttaagagtagaaaaaggaataaatacttttttaattttcctcatcctcctttctccattcttcccctctatttaatcctccttccttcccagtcctaaataaaaaccaacaaaacaaagccaaataacaaccgcaaaatgacagtggctctccccttcaaccccacatccctctagggcaccctttttacatacatagcaggttgttgggtgggacttctgctcctctagaacctaccaggaggacacatgcataggatcaggagatgataagcaccccacattatagggaagccacagacagggagaaaacatctccttggggcttattaaagaaagctaatctaactctgccacttttgccatccctggagcagagtccactccatcatttatgaatgaccaaaaacaaggagattcaaagaaatcctgagagatggggatgagccatcagcctgggtgagctaaccctggcctttcctccccttcctatagagcgaggtgtgaaactacttctctcttattaagcaaagaaagagggctgcataagtatcaatcacagagtgacctgtaagaaggggagactggcttcttttcccaggtggaatgtctgcatatgcagcctatttgctcagctgctcatgcttatctaagcaggggaaacaattagagaaagagcagagcagagaaaggggtgataagtgaaacatctttcatgtggatttgtaagtttcctctggatagctgaattgtagggaagatagcttggcttgaaccaactttctagtactccaccaagaccaacccccaaggtggatgctaacggattgaaaacccaagtggggcttccacattgagaaactgtgcagtggaaaagcctcctacaagactccagtgatttcatgcaggcatcttaggagggagactcaatagtcagcaattattattcagagagagagcaacacccaacagaggatataggtgcaccgttaagtattaagcttgttaaacctctcaccttacctcttccacctgccccatactgacaatatgaaataagaaggattagaggaagagtgagggagcagaccctaccatcccaagtgcctcaagttgaagctttgtgggtgaggaaggtaacattaaatgaataggagactgagtttttaaactagattaatcaggactggcattttcaatatctgaaatcaactggaaagctattggtaaccaaggtgtttttaaaggacaagaaaaaggatccatcagaatacagacgaaggtagtgactaaagaaaaataaaatctattctgagtcagacttctgtctgaaaggtttgcatctaccaaacatccctaaaattgtgtcggttgcatttgctcaggcctgtggcaaatttacacaccacatcagctcaagtttcccatgaaatcacaggtaatattttgtggtgataaatgcaaggggaaagcagaagtgaaaatgtggcttgagcttggacagtcagagtgcactttccccctgggcaccatgtatagtccttagtctgctaagtaactctagcggactttgggaggcctcccctggttattttttgaaaagaatacagtgttcctttctttggtagtagaaaatcaaagtccacatgaaatcaggaagtcccaataaccatagagaaggcagcaataaggagtaggagagagtgaagtcaatacatgcagagacagccagggtaagggactgaggggtgagtcctgtggacattcggacccttgaagacagtcacgtctaaggccattgtctttctctccatcctgcgttttgattacaagaattcataaatccttggttctaagtttgtttccagtgggcttctgtcccctaaaaccaaacaatttcagagtaataaagctacatataaaaatgccatgtcatagctctggtttgtatctagctcaagggaacgagagacagaagaaaagggaggagtcttggtctagaagaaataggtaaggaaaggggcaagaggagacagcattggagactattaatcaggtgacgagagagtggagatttaaaaatatattgttggataagaggaactgttatgacatgaaaatgggctctagaaagtttcaccctacatcaaagaacagactttatagaaaatgtcccagagctaaatcagtcttggggaaacaggaatcatgcagagaggccctggacacctcaaaaggatccatacaccacagctaaaagaatgacctagtagagttttttaatcacagttttaacagtggaactctttcttctaacaaactgttactttgaacacaaatatataacagataaaagcaataaatcaattacttgagcaatttaaacctttattacttgacctccaatattcattgtttagggaacccctaaatcccctccaggaaacatttggattttgtggagcacaatgtgaaaaccactgaccggaaacacactcccacacatgtgcctgttccacacactttataccatgcttaaagacagcctgatactctagcaactatgaaaatagtgcatattacacagtactcatagcaaccatggaatttacatgcagacacttggcattttcagaaggaaaacaaaccatatctaagcttgcttatttagaccactgcttttatttattcctaccaaattcttatgttccttgcaattgcactcgtgctttcttcaatcatgccccacatactgctttttctcaggaatttccatgtatatttaatgcctatatcttgtaatttcttgaaaaggacaaagacagaagtccagccaaggccatgagactgtttttctcctaagaaactgtcagccaaatttctcagggagaaactggaaatgaagtgagagacattgataaatttccctgctgaacaatcaataaaagctccaccatcctgctcagattcccactgtggaagcaagagccgtaattacgttgtcaaaaatttaagttgcccaggctgacagcaacccacttgaaaagtgacaagtgattggcactcagtttggagtggtgaacctggattggcagacagagtgatgaaagcaaaaggcaagagtgaaatttccttattgactacagctacccaaaccccagactgccactcaggaggaatcctgagaccctttagtcatattaacgcatcaaagtgagcagctgacagaagttactaaacaatctgaactccaccagcaactcagaacctgtcctcatctactctcaaacagaaacagaaaagatggtgctgtgtgtgggtgtatatgtgcagctgtgtgtatatgtgagtgtataagggtgtgggacttttcctacattcaaagaaatacatgtaacgtgctttcaactccatcttgccttgtgacagctgaacaccaaagcctgtttgcttagcgattttaatccaaggtaaaaatcagctggagcagaagggtttcaaagagcaataataaagaatgagatggaaggagaaggtgggaaagtgatcggactgacatgcagaccatttgtgtgattctacatgacctgagctggagttaaattagaatccattcagcattgctgctgaatattaggaaccaaatgtctgccaagggcctcattcgctgggcagtgccctgcttcagactatactgggacccatgcaaatagtttctaagaagccttttgtaaccacgcccaggaatggtggttatccacagctgggaagcagctgcaccaagagagattaaaatctaaaggtgttgactgggtggtgggaagagaagagaagatgcctgggaatgttgttaccacatgatctccaaggttaaaacccttctgttactctgatgaaaagagatagacaagaaaattaatatgtgttttgtgtgcccaacactctggaacacttcatgagcaataagtttatgaagtgggaactgtgtttttctgattttttagagatctgttgaaggtcatagctgatctgtggcagaactgggcccatttctgattccaatttgattaaccacttgaaccagtgtttctctgagtatagtcaataggccacctgagtcacatcacatgtacatttccaggcccagaaatctagatttacaaaaacctctcccaaaaggctcttctgtgcgccaaagttggtgaatctcctcattatgttatcctgggaaactgagtgaatgctgggtcattagggacttcctgggtgcaaaacagtgaatcaagttgctcactattttgcatacttgatggtgaaagaaaattagctttttcctaaagccccagtgtcaccagacccacctctggccccggcaaaaggccagtgaaattatgaaatgactttagccatgatataccaccacgctggaggggaaatctgtctgagacctcaggtggtgagggagaagtgacaggagagaattgatgagctgcacgtggggctgcgattctctgacagatacatcaggaaaggaatccctgtcacccaaatggctgagctcttttctacataatatttgtttcaaatgcatgagatgctgcagcatcacatcagagaggaaatggcttgatctttgcctgtgttcaatgggcaagctctgtgattcaggtgagatcctagtcaattctctgtcctaaatgctttggggaatgtttaaccagttttgaaaatggcctaatctgggaatataggaaaagggggagagagagagaggagggagaaggagaataaaggagagggagggaggagaggaagggaggaaaaaggggagagagagagaggagggagaaggagaataaagaagaaagagggagaagaggaagggaggaagcatggagagagaggagggagaaggagaataaaggagagggagagaggagaaagaggaaggaggagatggaaatgaggaaagcagagggagaggaggtctcattctcaatatccagtaacatcagatggctgaagtagcaacattttttctgaactttcagaattttcaaaccatattagaggcatatactttgcttgaattgccccatattgactgtaagcaatgggactagggattttcttgacatttgcttaaccacaaaggcttacatgcacaacgtacatttaaaatacaggcacaaaaggtatatttatgagttctttctttgattcttcacaatagagcatgataattagatgagcttggaatgaaagaggcagaagaaaataattaggagagttttcatttttcctcatttgaattcctattttcaggaagagctgtgctatctgcatcatacaggacagtggctctcaaatctgaggattcctcctaagcctggggtcctctggacgatctatgggctggctgaaccacaaatatacaccaacttattccccagatgcacttttttactggtaaaaagcaacatattgggttagtggcttaagaggccattgagctagagcaaacatttgaaaaccatggctgacgtgggaatagatcctgggctacaaaatcaatgtagttgcttgctgatgaagataggaggtaaaaaggtccccttggaagttgatcatagaatcaacatagcaagcattttgaatttctatccagtgagttatggggtatttttaacctcacaaaatttgatccccagtgtctagcacactgggtagcccacagtcaacacttaaatgcttgaggaaaagatcttgcttcctttcatagtaagccaaaagagacacaagcatgttttttgatagacaatgattggggcctgtggtcggtatgagacagagtctggataaagaaaaatggcagattcctcagcacagctccatgccctcatctagagcaattatcctatgacaagtggattattttgtgatgccaatatagaaatatcattgtgtaactgacattatgatttctggagattgagtcactatctggagcccacattttttatctgcctttggctcatgctatgcaaccaaaagcatataaacacccactgaaatatgcttactcattattttatactgatattttacagttgatactaaggattatcctggcacacctggtaatttcctgactctcaagagggaaaaaaaatgtccattttgcaaagtggaattagatgatcagaaagcaaataaagttggagtagaacacactgtagcctaatctattttctcctgggaatccttaaacaccccacctatctgtaagaggattctaagtagaactgtaattaaaccctgctcatggggtagagggtttggggagacaggaagaggttcaacaactaaatgaggttgtctgtatttgatttgggataccaggctactgcatgttgagagacatcagtacatgctaagtaattgtatcagtcagttttcactaggctatgctgcaattacaaatgcaaatttcagtggcttatgacaaaggcttatttctcactcacatacatgagagcagtaggtcagctgcagcactgccccatgtcgtcttcgttcaggttctaagcagaaggaactgcctctatctgggacaggctattctcaagtggcaggaagaaaacgaaatggctaaagcatcgtaacaggtcttaaaaccttcacttggccatgcagtcccccagttctgctcacattccactgaccaaagcgagtataaggctaagtctgctcttgcaaaggggccgggaagtatggtccacccacaaggaggcactgaaagtcacctaacagtgggtggaagtatacacaatcctcttacagaaagaggagcaaacaattgggaacggtagtgtactctgccacatgaatcgtaacagttttacttgttatttaaggaaatagtgccatgctctaactgacctggttggctcagcaactatagtcaaggacttttaaacagttttatcagtttccactgctagacacagctctacttcatttcctctgatcaattgcctcactcaccgtgcagagaaagagttccattcctcacagccaggaacttgactccatagggaaagaagggagttgagtaggaactcccgtagagtgtgatctgagctctgccttggaagggcttgtcttcggatccaatccggagctctccaccatcagaaacaaggatggcgtgtgccctgagctcgatgggtcctggggccatgaaaatcagcttgccccctaatggacaaagggaaaattgtcagtccctgggaggataaggcttaccgttttgtcagtttcaatgcctgatgaaatccccttcatttaaatacttctgctggaatgtagacttattttatcatgctctctcttgtagaagcacagtagggtagaccagacattcaggagtggaagcactattatttagccagtttaggttagctattactattctctgctgctttattacattttcatgacaataatctaaatgtccagcaatttaggaatggttaaataatgtatgagaagaccactaactttaccatttaacaatagataaaattaagaaaaaaaaaaactgggacatatacaagaaatagggctagaagaagatgtgccaaaattgtaagaattatagtaaaaggaaatgtaactagggctaacactgtggcatttgtagcattttagctgaccagcatccattatactttcttttgttaacagaccctaatttccttgaggtattgctctgccccattgactagagctgagtggaactgtcaagcaagacatcttatcctaccatggccagagtcacatactcgggctttaagagaaatatggagcaaaagggaaaagaggtaggaaatatttagatctcagttccagtggtggcattctaaggagcctgggaagaacacctgcttctgagatgcccacctgcccatctccctgcctgccccaccacccgccacttgcatcaaatgctttgattcctacgtatttctgtccctgatttttcagactgctttccactgattagtaggttacccaataccttcccaatacattccatttttaaaagaaaagttgggttctcttattggcaaccagataaccttaactgatacatataccattttgctctgatgtccaaattttcagtaacacaagaatattcgtttataatagaattattttgcattgtgagattaaataatttaaaaattaaaaagatattttcatttttataatatctttctttaaaaggctttagaatgtttatattttacgtagaattttctcaataatgtcaaaataattaaagcatcccatatgaataaacactttaacttcaataagctatttagtccatctttctcctgcaagtggtttacaaaaataccagactagacccttccatcctgtaacaaagtagtcagaattgtatctttatatcagacacaccagaggtcctcttttctaaatccaacaatagtttcccatctcactcagaatagaagtcaaagtccttacattgggctacaaaaggtccctcatgatttgctacccaacctccaatacctctctaatatcattttctaaagctcacctgttcacacatatgctacaaacatattggcctgcctgttagttctcaaacaggcctcagggcataagctcttccctctggaaggttcttttgatattcccgtgaatatcatgaataagaattatcaaaaatatcggaaatatctaaaatgttattggaattatcggaatgttctgatattcccatggctcactctcccttgttactattcaaatgttaacttctcaccaaggccttccctctccagtctatataaaatagcacaccctagccccttgcctaaatgcctttttctttgtaatacttgatatcaggcatattatatatttacaggtttattttctgccctctccccaccagaatacatgcttcctgaggggaattatctgttttgttcacttctaaattattggtgtctagaaaagtggctggtaggtagttggcactcaacacacaattaatggttgagtgaatgaatgaatggacatatctttttggagattctgatttaagtgcctctatttccttatatacaaacacacacacactctcccattttctcagaaaggatgttgttcttacacttaatttataagcctacatagtgtctcaatgagcaaaggggggcaaaggatatagagatagcaaagtatcagaaatgcctcaaaaggcagattctactataataagaagagtcttggtgagatgtagtggagggcaaagactcttcatctgctaatgtagtcataaatccagagtgccaagttattgagttgagtttttgttgctttccagaaatcacagctggaagtagttaaacatgcactggagaaatgagagggagagaggaaaaaggcaaaaatgactttagtcattatcatgtaaaccaaaaataaaattttaagtcccccaaaccaactgaattgacccctcctcttaggcaagggcgttacaaagttaaactgtaaaactagttcaggccatgacggggagtgtcagagatgcctcattataccctcctccctttggaattcagaaataagtaaccagcattaacattaaaacagagacattaagactgacaaaatagactctgtagcaataagacaccaaattccaacctgactctagtacagcaccacatgacagatagccggccctgaaagaaactgaagtattttaccccaaaatatattaaacggccctgcaaagctgtctcttgtggggaaaatctacattctgtagaaaattcccttccttttctggatctttaccctgagctaggagagtgctaactaagagtctggaacctttttagatctgctaagaaacatttacagtctattctctctgaagcctgctacctggaggcttcatctgcataataagaaccttggactccacaaccacttatcttaacccagacactcccttctgttgattccaggtctttagataagttaataagttaactctttcaaccaattgccagtcagaaaatctttgaatccatctatgacctggaagcccccactcctacttgtctaacctttccagaccaaaccaatgtacatcttatatgtattgattgatgtcttacctctccctaaaacatataaaaccaagctgtagcctgaccatcttgggcacatgtacttacgacctcttaagactgtgccccaggccatggtcactgaaatttggctcagaattaatctcttcaagtattttacagagtttgactcttttcatttaattgtttacctccgtcttagtgcagagacagtgatcaataaatgtttgactcaatagtcaaatatggaggccacttcttccctaacttctcttcagctttcctcagctcctttcctcaagactcttttcttcaattctaaagcccaagccatatgccatcagtaatagtcacgggatgtatacttggaccagaccccttcaaggaccttttctttcagtcacaatttagaatgacacaccccgcataggtatccagtttctccatctgtaaaatgggcatggtaagaatttcaccctcagaagattaaggtgagatttattgaaatagttcttatagatccctggtctggagtctgacacctattcaacccttaatgcaatggtctctgtggctatcatcacactcaccatcttcgcttcctccattattgctgtgaaaccatccttgcaaagattctgacagtgagaaaaatctaacatggcttactccatcttgttcctagcctcacaggctggctggctttgctcattcctaggtgtaagccaagctaactatgggaggaatttagtttatagtctaaccttaaacaaggatgataatagcccttcccaaaattaaactacctttgtaaaactaatgaaaggccacaaggctaggattataagaggtgccaaaattctaagatgtttagcatatttaaatgattactagccattgttcaagaggtcacaagatttgcaactcttccaaatactccaatagataacatcactattttagaaactgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaaatggctggtccttgcctaactgatgacattacctggtgaaattccttctcctggctcatcctggctcaaaaagctcccccactgagcacgctgtgaccccccactcctgcccgccagagaacaacccccctttttcctttacctccccaaatcttataagatggccccactactatctcccttcactgactctcttttcggactcagcccacctgcacccaggtgaaataaacagccttgttgctcatacaaaacctgtttggtggtctcttcacacagacgcaagtgaaattttgctgccatgactcagatcagggaacctcccttgggagatcaatcccctgtcctcctgctctttgttccgtgagaaagatccacctatgacttctggtcctcagaccaaggaacatctcaccaattttaaatccggtaagcagcctctttttactctcttctccaacctctctcactatccctcaacctctttctcctttcaatcttggtgccacacttcaatctctctcttctcttaatttcagttcctttccttttctggtgatgcagaagatgcgttttatccatggacccaaaactctggcgccagtcacggactcaggaagacagtcttcccttggtgtttaatcatgcggggatgtctgcctgattattcacccacatttcagaggtgtctgaccacgtggggatgcctgccttggtccttcacccttagcagcaagtactgcttttctggggggcaaggacccccctgaccccttctctccatgtctctaccccttctccacttttctggggggcaagaacccccccaaccccttctccttcacccttagtggcaagtaccgcttttctggggggcaagaacgcccagaccccttctctccgtgtctctaccccttctccgcttttctagggggcaagaacccgctgaccccttctctccgtgtctctactctctcttttctcttggctcgcctccttcactatgggcagccttccaccctccattcctccttctcccttatcctgtgttctcaagaacttaaaacctcttcaactcacacctgacctaaacctaaatgccttattttcttctgcaatgccacttgaccccattacaaacttgacagtggttccaaatagccagaaaacagcattttcgatttttccatcctacaagatctagataattcttatcgtaaaatagacaaaccgtctgagatgcctgacgtccagacattcttttacacattgtttcctccctagtctctgttcccaatgcgactcatcccaaatcctccttctttccctccctcctgttctctcagtcccaaccccaagcatcactgagtctttctaatcttccttttctacagacccatctgacttctcccctcctccccaggctgctccttgccaggcccagccaggtcccaattcttcctcagcctctgctcccccaccctataatccttttatcacctccctcatcacaccaggtctggcttacagtttaattcctcgactatccctcccccacctgcccagcaatttcctcttaaaaaggtggctggagctaaaggcatagtcaaggttaatgctcctttttctttatctgacctctcccaaaatcagttagcatttaggctctttttcatcaaatatgaaaaacccagcccagttcatggttcgttcagcagcaaccctgagatgctttacagccctagaccctaaaaggtcaaaaggccgtcttattctcaatatacattttattacccaatccgctcctgacattaaataaaactacaaaaattaaattccggccctcaaaccccacaacaggacttaattaaccttgccttcaaggtgtactataatagagtagaggcagccaagtagcaatgtatttctgagttgcaattccttgcctccactgtgagacaaaccccagccatatctccagcacacaagaactccaaatgcctgaaccgcagctgtcaggggttcctccagaacctcctcccccaggagcttactacaagtgctggaaatctggccactgggccaaggaatgcccacagcccgggattcctcctaagccatgccccatctgtgtgggaccccactgaaaatcggactgttcaactcacctggaagccacttccagagcccctggaactctggcccaaggctctctgactgactccttcccagatcttcttggataagcagctgaagactgatactgcccgattgcctcggaagcctacaggaccatcgcagacgctctgggtaactctcacagtggaaggtaagtccgtccccttcttagtcaatacggaggctacccactccacattaccttcttttcaaggacctgtttcccttgcctccataactgttgtgggtattgacggccaggcttctaaacctcttaaaactccccaactctggtgccatcttagacaacattcttttatgcactcctttttagttatccccacctgcccagttcccttattaggccgagacattttaattgaattatctgcttccctcactgttcctagattacagccacacctcactgctgccctttaccccagttcaaagcctccttcgcatcctcctcttgtatccccccccaccttaacccacaaatataagacacctctactccctccttggcgactgatcatgcaccctttaccatcccattaaaacctaatcacccttaccccactcaatgccaatatcccatcccacagcacgctttaaaaggattaaagcctgttatcactcacctgttacagcatggccttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccagcccagcatggccttttaaagcctataaactctctttacaattccaccattttacctgtcctaaaaccagacaaggcttacaggttagttcaggatctgtgccttatcaaccaaattgttttgcctatccaccccgtggtgccaaacccatatactctcctatcctcaatacctccctccacaacccattattctgttctggatctcaaacatgctttctttactattcctttgcacccttcatcccagcctctcttcgctttcacttggactgaccctgacacccatcaggctcagcaaattacctgggctgtactgccgcaagccttcacagacagcccccattacttcagtcaagcccaaatttcttcctcatctgttacctatcatggcgtaattctcataaaacgtgttttccctgccgatcgtgtcctactgatctctcaaaccccaccaccttctacaaaacaactcctttccttcctaggcatggttggatactttcgactttagacacctagttttgccatcctaacaaagccattatataagctcacaaaaggaaacctagctgaccccatagatcctaaatcctttccccactcctctttccattccttgaagacagctttagagactgccccaaccttagctctccctgactcatcccaacccttttcattacccacagctgaagtgcagggctgtgcagtcagaattcttacccaagaactgggactgtgccctgtagcctttttatccaaacaacttgaccttacagttttgcctagccctcaagtctgcgtgcagcagccgctgccgccctaatacttttagaggcccttaaaaccataaactatgcttaactcactctctatagttctcataacttccaaaacctattttcttcctcacacctgacacatatactttctgctccctggctccttcagctgtactcactttttgttgagtctcccgcaattaccactgttcctggcccggacttcaatccggcctcccacattattcctgataccacacctgacccccatgacttatctctctgatccacctgacattcacccccatttctccatatttccttctttcctgttcctcaccctgatcacacttggtttattgatggcagttccaccaagcctaattaccacacaccagcaaaggcaggctatgctatagtacaagccactagcccgcctcttagaacctctcatttactttccatcgtggaaatccatcctcaaggaaataacttctcagtgttccatctgctattctactactcctcagggattattcaggccccctcccctccctacacatcaagctcggggatttgcccctgcccaggactggcaaattggctttactcaacatgccccaagtcaggaaactaaaatacctcttggtctaggtagacactttcactggataggtagaggcctttcccacagggtctaagaaggccaccacggtcatttcttcccttctgtcagacataattcctcagtttgggcttcccacctctatacagtcttataatggactggcctttattagtcaaatcacccaagcagtttctcaggctcttcgtattcagtgaactaatagtcttttaaaaacacacctcaccaagctcagccaccaacttaaaaaggactggacaatacttttaccacttgcccttctcagaattcaggcctgaactcggaatgctacaaggtacagcccatttgagctcctgtataagacgctcctttttattaggccccagtctcattccagacaccagaccaacttggactgcatcccttccaccaaaaaaaaaaaaaactcatcatccctactatcttctgtctagtcatactcctattcaccgttctcaactactcataaatgccctgctcttgtttacactgccggtttacactgtttctccaagccatcacagctgatatctcctggtgctatccccaaaccaccattcttaactccctcttaaagtaaataaataatctttgctggcagggctatgctgaacctccttaagcactctctagttagatgtcctggatcctcccaattcttaatcctttaatacctgcttttctccttgtcttattccattcttttttcaattcatacaaaaccatatccaggccatcaccaatcattctatatgacaaatatttcttctaacaaccccacaatatcaccccttaccacaaaaccttccttcagcttaatctctcccactgtaggtttccatgccgcccctaatcccgctcgaagcagccctgagaaacatcgcccattatctctccataccacccccaaaaattttcaccatcccaacacttcaatactgttatgttttatttttcttattaatataagaagacaggaatgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaatggccagtccttgcctaactgatgacattaccttgtgaaattccttctcctggctcatcctggctcaaaaagctcccccactgagcactttgtgacccccactcctacacgccagagaacaacccccctttttcctttacctccccaaatcttataaaacggccccgccccatctcccttcactgactctcttttcggactcagcccacctgcacccaggtgaaataaacagccttgttgctcacacaaagcctgtttggtggtctcttcgcatggatgcgagtgaaaaacactaagattggtcttttgagatttttttttaggcttttgtatttctgaccaccagctgacttcactcagattcatgacccaagactcaaccagtgctgtggcccttacctaaagacagactcagtacacaaggactgttttccatacccctatgatttcatccccaacaaatcaatattccccataccctagttccctgcccaacaaactacccttgaaaacccctaacctctgagcctccagggagattgatttgggtaataaccccatcccccaaatggtgtggagggccttgcatcagttaaatgctttctttactgcaacgccatggtcttgacgaattgattttgtctgtgcaactggcaggaagaacccaccgggtgattatatctacaacctgctcaatttctacaagtgccctaccacttgagcactgctagaccatctgcatccaacatctctctgttactggtccttttgaaatattttgtcatatataatatttcatactctagggtaaagcagcaaggtcagtctacaggctccatgccagagcagtaccacactgcttaccagacttccaaaggattccctaacaattttgacttttttcctttcattgtcattacatagaaatgcagtaataatcatgagtcccagtgtgagcaagaaggaagaaatatgacctgggctacagatcaaattttatgttaactaaaatttttccctcacagccacatgtcattaacatcctaaataattatattcaactggtagaacatggatttgtatgacaggactgccgcattgtaaatagtcaggaaatctaaactgaccttgatgagcaagtggtaaaggcagggaacaaaatcaaggttcctgtcctgagtctgctattgacctctgaatgagcctcagtaagtcccatacaattgctgggcctcagattactcaggtcccaaatctctcctactcagtgcctattaatggtctgtggtttcatccgcaaagtggaaggtggaattatgagttcctttcaactctagaacacttgacgtctacatctttatgaatgcagtcagatgtgcatgggacactaatggaggcacaaggctcatgttttcctgacactgcctgtgctgcagtaatcactgaattttttcttaagcaagatatgagatgcatagtcaggaattcatataagactacagggaaaacaagaaagctaacatttattcagcacctaccatgtaccaaaatctgtagatatattgtctaaaatgaccttcaaaaccagtctgtgagatcaagatcacattctttatttcacagagcagaatgtggctaagaggcattcatacctattccagcccagaatacacagaaccaaactagaacccaggactacccaaccaaaaggctcagatcctatccatttgcacaaaccttccccagtagctctcaattcactagggttgttctcatagttacatttaaggaaaaacatgtgtgaacctaagaaagtttgcctatggcttgtttatacatgatttattttaattttgttaatgaagatataccttgtctttttccaaaaaggatttgaaacagattacaaggattagtgggtaaatatataaacatgggctttgtcccttttaccatgaagcaaaatgttaaatacactgaaacaaattggtagaaattttgaaacatcatttactgacaggaactaataatgatgctaatgaagggagaaaaactcatcccaaagaaaatgaattatctgcgttgtcaggagtgtcataaacaggactaattaattaatatgaacatcattaactcctgctaaaaagcatccccaccccgctttattagtggcaaatataagaaaatctaggtacatttagaagaaagtttgatgaggaattcagctatttttgcctgaaataattagataaacaaatgaaaccttctttatgtgaaagaagataaagtttatacttaatctatctttatgccaaggcaccaagattttcatcctcacactttattagtttaaaataaatatacagtgggctgctttaaaggatagttacttgagtatgggagggctgtgggaggactttattccatactttatagagcttgaccccatttctaaatgctgaaataaagagcagggctgaaatcagcctttggctgtgacccttaaattgcttgttatgactttcatgaaagctgactatgtcccacaagtaaccttgggtaattttataaaaatcaatcaaccatcattattgttacttccctctaaaataaataaatgaacacaactttttatatgtaatcacctctttccattaaacatctcttttgtttcttttaaagggaagtaaaagagacttttagcagctagctaatgtttgcaaagtacatcaaaatctgcttttggctaacccaacaattagtcatcctctataataaccacaaaataatttgttgttttttttaagaaaacaaatacacaattctattttcccccttacagaaaaaatttaagtataaatattataccatacaatactagtcttcaaaagagtggctatacctactatcttcaactctttttcatgactgtcttttgaaccctccctggtcaggcctttacctgatgaacctgcaaaactgctcctctcaaggccacagatggcaaccacattggtgaatctcaggctcaatgctcagtcctcacccttcccgagtgaccagcagcatttgacaacttggtcacttctttcctaaaactccctctcctcacttgcccagcctctttgtttttctttctttcattttctcatctctatttaaaaaatccaatgtttctatacttctatcaaattttcatcatgtgctatattctatacattgtattgaatcgctaaagaaaacctcataaaatgcaaaagtgctagtaactcataaaagaacagaagaataaactcttctatttagaacctttgtctttccttcacctggtatctaatttcatgtcttcatttttagcaaatactaagaaagctccctattgactcaatgacagtgagcacatgggacttttctaattaagtaggttgggtacaaacccagctggttttcctcttacttcttaggcatcctcttctcagcctcttctgcctgattcctcctgatcatcccaaccactgacacttggtgggtcccaagcctcagccctctaaacacgtttcttatcagtctctgtagaccatgccagttgtcccatcttgtcttaaggttttaaacaccatcgcacgctaattgtcaatgactctcaaatttatatctccaagcttgtgccctcagctcaagattcacatacccaactgcctactcaacatctctacttggatgtctcatagtttcttaactatgagtatccatgaactcctttccttgtcttgccccacagatcttccctcagtccttcccattccatgaatggtaacttcatccttgcaattgctaagtctgaaaatcacagagttaactttcactgtctctcactccataatcaatacttcaggaaattgtatgcattccaccttcaaaacgtcccctataacccaaccacttaccacctccacatctacttctggggtccaagtcactctcatctcacccatggattattgtaacagcatcttaacttagctccctgtttctgcccttatcctctacctcagggttaattctcaaaacaacactcagtgttgtcattccttcttttcatgtgaaccatatcgtgttacctctctgccaaaattcttcaatggctcccatcatatttagagtcaaagcctatcaaaccttacagcgttggttctctctggccccatctgcctctgctctcccccttgttccaatactcctttttgctcccttgcctcacaacatttgctatcgctgtgtgccaatatccccaactaccacctccaatgtgtattccctattcacctctcctgctgcatttttctccatggtactaagcaaatttaacaaaaactataattttcttattttgtttattgactgttttccttctagaagtaaacaccatgagagcaagattttggcctgttttgttcacagccatagtccctgtgcctggaacatggggaacgtgttaagtgatcactcaatacttgttgaataacgaggagttgaaattatcaaagtaaatgaggtctcccagggaggacatgtagagtaagaacagaagaaaggtaaggtgggtaaaggtagggaaacaactgtcaaccatcaacatttaaaggctagaataagaaacaagattcttgagagcagatcaaagaattaggtgagttagaaggatcataaggttgtagacataggctcaacgaagagccttaagaactgttaaagaggtagatgagtgtgtcaaacccttaatgccatttttaggaagatcaagagagaaaaggtgcacagccagcatgtacagagttaggatgtgaatgtcaggtgataaaataaacccagggagagtgattctatttttaaacagaggaaaaatgagaggtaaatggaggcaagaccagggagggatctgagaaccccaattcattagattaatctgtatcaccaagctagataattcatttactcaaagcttgaactatctaaatttttagatgtaaactaatttacttgcctacattgattaacccccaattcaccattttttcttaaaaaatttagcagcctatatattcttacctttcaattattaaatagtcaaatggatagtcgaggaagcctgtggaattccctttccctggagaaaaggaatcatccattcaagatggacaaatcctgctctgcctgggtaaggagagctggctgagtgatctgggcagagttggagtatatccctgtaccttactgcactgtgctgctctgggagcaggagccaggagaaggtgaggaagaggaggaaagaggagcatttagagaaggcacccacagcccaaagaaacctgcattgtgacacggatggacacagcttcctttgttggcaagatccggattagacttgtgcctgatccactggagcagagcctgggaagccttcgaggtgggcttgtccccagccagagaggcggaaaatcaatttggctggcaaacgagagcccccaagagcttagtccacgctccataatcctatccactagcagctcaggaaatagatgcctgagccctcacatattcatgggggatgtgaggcataaatcaggctttaaggattgggggcaaagggaatggactctctggctggctactaattaatcaagcacagaatacctaaacctagcaacctgggatggagccacacacacacagaagcagaggctgctgctgctgctgtttttcccatttttcaaaatttcaattaaaatagatatcagaagaaattttcccctttagctgatactgcttatgcatctccctgttcttcctttaattaaaaaacatgcttattgcaatacttgccagaatcactttaacggtattttaattgtaatgtctctgcctgattaaaaaaagaaaatatgaactagaaagtgtttgcaaaaatgttcacaggatgcaggacaagaatcagacacctccccagaatggatgccacatactaattccttaattagcctggtactgcagtcaaatgggcaatatagagaaaaaaaaaaatatatatatatatatatatgaaataaaatcactgactcagagctgcaaacaatagcagttgggagaaaccattttcatcaactcagatttccctggcggggtagggacctgtgcatccaactaaaaatgctgtgctcaagataagcccattcaatgtggccagccaagtttccactgttctttgctaaaggtctcatagcctttgggaaatgagtagttgggccaggctaattggcttctggtcctcacaattccatagggctccttttattgttttaggctagtagttctcaaacttgaacctgcatcagaatcacttggatgtcttaaaacacagactactgggcctcattcccagagtaggtttactgtagagctcccaaatttacagtttgtataagttaccaggtgatgccagtgctgctgactgggggctacactttgagaatcactactatcagtaaattaagtgattgttctaggtgtccgtaggctggtgatgtttggcatcatctgaaacaggctgagaaaatacaagcctggaattatagaataattcccttagtcactcaaccaacatttaccactagtttccagctcctctgctaggtaccgaaataaaaatgtaaaatagagtctccagtttctgaaggtcacggtgaagttgaattgctcctccgggtgaatggaaatgtgttggttttagtgaattgtcccactttagagatgactataagagaatataaagactgtgactcagctctttactttttctacaaaatatgaaactcattaaggtaaccttataactgtattaactctgtactaattacagagtgtaaacatatctgtggaaggcaaactacacagaaatatttaaaggaactcaaacactaagatataagtaaatgcctttgttattatagctactgttatcaattactacctaactaaactttgatttcctttctacatctagaaaaccatgacttattttatcaacaaagcttctagcatttaagtgctcaaggccttcagctgttccatggctttctaaaaagtcacttaaaatctcaagaagaaagctatttctaaggagaaatagaaaagacaaaaaaaaaatcgtctttttcccgaggtctgtaccaagcatgtaaaaatccccctagctactaagttcattcagataatcttcctctttctctttatcaaagttcagttagcactgacccaatctcatttttgaccagcctgcaatttgatacacctctctaagcaacttgttttttcaaaaggttccaaatataattattctctgaatattataaaaatgatttggtatagcataatagtattggaaataaaagcaaacaatacttttcttatagtatttattaattttaaaaatgagaatacagtacttcctacctttacctgaccccaggaatattgtatagaaactataataatgaaatgctcagtccccaacatatttttatctacacaagaatcccaaatacaaaagtacttcagatttctagctccacttccagtccaggatgaataggatatagggatcattaatgaacaaatgagatggagaggtaaagacagaccaagtcctgcatgaccctataagccatattaagtttggacttgaacttacaggctaatggaaagccaatgaaaggttttaagtaaggaagcttgaaacatttatctttcattactgaaaatattatagcttctctgctaggaagggactggtccctttcagtagcatttttcatgttacaatatccaagttgtcaagacataaaactgtaaattgtttaatatctatctatctgtctgtctgcccatctattgaaagcatgtcctttctcatagcaatggcttatctttcatttaaggctaatcaagtgtgtctgggactgttctctggaggtaaataatgtaagtcattgtctgattggaaaaataaggggtctcagagccaagtgtcccccacattaaaaagcctttgtctctgatctcctgatacacaaatagtaaataaaattggtcactgtctggactaatccactaacatttgagggtaccaggaaggactctgattatagagaaattctcaacaaacatgaatctgcctcttcaggtctgaaactcatttattagcttattcattcagccattatttgagtacctgtttcgtgcctggagataaaatggtgctggcaacacaaaggtgagcaaaaacagagctggcccctcctttcttcagcttacagcctagacctttataagcctccaaaatggtagagggaagaaaaaatacaccttgatattctatttgtaaataattaatataaaaataattcaagtttttaaccaattaaaaattctacctgtgatacacttagctttgaatatcagcaaagttcccctcccatgaaataagtaacacctacttgtcaccaagaaaagcccagcacatgaagacacccaagagttaagagtgaacttcaaaaaaactcgggctagttctgatgctaacttcttcatcaggcctcccttctggataatggcacagaccagccccttagggtaccatgcctgccaaatataggaagaaaatttactcattcctatactgctcttcctccacagagttgcacacacacaaacaacattaacatccagtagaggtttatacaagacattttctccctacacagggaagggaatcaccattatttccattttgtgcattgatttgaggaccagagccttacccaaaaccataaaagagtctgtgactgactcaaatttgaagtcaggctccagtttgctgaccaaactgcaatgaatcaaccttgttgtattgtctgcacataagcatcctatcttctggcttgaagggtagctacgttttgactacaaaagagggcaattcagtccatcttcttttacagccaacttgcagataaattattttgaatttaccaatttgcaacaatgtttccagcccacaaaaccctctcctgttgaccaagatattctacagttagagaaaaaaaacaaattattgttgaatatcatatttttatcaaaattactgccttccttcagattttgttttatcctaactggtagctatgaagtcttgaaactataggcagagggtaaaatgccaagtgactcacacaggcctgatgcacaaagagatcacaagcaacatctcaggaaagttctgtgttgtaacatttctagataactgcattggaaagcattatctgaagcatgcatctactgaatctgaggctggcttagtgctaactagaagcaaccaagtatacaatccctgggattaaaaaaaaaaaaggctgtgataggttcatcatttaatacctcactctgaaatcctcaaatgcttgtcaaggatgaaggaattctacaatgaacctgacagtgagtcagaagaagatgcttcatttcaataaaccaagaatatgcatttccatgacatagaaaccccagatgtaatggacttaaaaagatctgaatgtcctcaaaactgtgaactaaaaaacagttgagagaaaatgagatcatgttccaagctacaccagaaaaacatgtttctgtgaagtcaaagtaacaaggagaatgccggcaagcaaatggatccacttctccatccgtccctccctcgcaatagaaggaaaaacacttcaatatgcattctgaagataacagaagcaaaagcaatccaaggtctttattacccagctaattctttcagtaatccagtttgctttgtatatagaagcagccactatctgtaaataaaattgtaacttaagcctgatattcagccatatctcctgttatctctgacagtccaaaagtaacaaaaactagcattaattgagttcttactctggaccaggctgtgtgctaatggctttacaaatatcccctcatttaatactgaaaacatccatacgagacaggcaatacattgtgatattgccatgcaacaatgataaatgctagctctcattgttactattattgtcattataaccaggtatcaccttaatgaggaaaaacctgagacttacagaaggtctgcaacttgcccaaggtcacagagctgggaagtagtggagcccagattcaggctcagttctttgtggctagaaatactgccaagcatttaactgctttagtataagccagtagaccaaaaaatagaaaatcacattaaaggaaaccagtgcactattaagcagcaacagagactggaaacaagtttctgctcagacacaagcactggcattgtgagtagtaagaaactacaaactgtcttccttttttattgtatatatttaaggcaaacaacaggatgttttcatgtgtgtatgtgtgtggataaatatgtattatatataatgcagtaattactatagtcaaacaaattagcatatcaatcacttcacagttaccttcttttgtgttgtgtgtgtgtgataggagtacctacacctaacagctcaacaccaaggagagagttcattctcccctaattgaccctttcattaatcattatcgttacactacttcacatcaagctgcttgatgaccagatcagaaagagattcattgcttcattcaggaaatatgaatgtttccccaactacagaccacaacccaagatccttgcccgggatgcagaatgctctgacaagagggtaacgttccttctttgtgattatggctcatcataattacttggaataaaaataataaattttaattcagcaatgcctatggccattgggcatcttaacataaaagaatgaaaatataattaactaaatcaaggcaatatgcctatttccatcccagctcattagtattaattgattgggttaattctcttttgtgtttaacggtgcccctaaaaaatattttttttttaaaaaagggagggagggcaggaaggagggaagaagtagagatagtaagtagacaaaagttctggatctttttctaattaaaataaaataataaatgcagctgaagctcttatcacagtcacaaaagaatctgctactttttaagttgggagtcagtacatatagcatcataaataatgacacaaaacattggggccacttctcaattgccccccaaaaatttatgaccctgccttctactatataagtaatatgtgtaagaaaaaaatgtcaattctattttatagatgaaaatatgagtaaggcacagagagttcaagactcttgagggtccataaagtgttggttttcctgttgtacgagcccagttttctacatatcaggatgctggcttccatgaatggaaaaataatataaaggatgtaataccttcataaagtatttccaaatgtagttcttaggtgatctagtttcactgttacttagcagtaatcctttcaaaatatatatacttcatgtagaatgtattctttgtaatatagaaatggctgagaaagtacttccattataatacttcatattttgtcggttaaaatcttttgaagaaattatttttggcttgaaatttctcaggctttatctaagcctgcagatggtatcagaaaaagtaaagaaaatttcactcagctatttttctgacactgtgaatgtatatgaaaaagatagtaactaatatttggagggtgagttactgttgttgttgttgatgatgattgtgattattcaatcttatatttgaagagctctttattatctttcaagtactttcacacatattatagaccaagggaagacattaaaagaggtttacagctatgttacattgatcagatatttgaaagttgtagttcttcaccagtgaagactttggtcatatgccttttagaaacagaaatataacttaccaacagattttatattcctaacaattcatcataatatgcaaatatatatagacatatgtgtgtatgtacatattttgcgtgtgtaaatatgtatatgtgaatatgtaagtgtatatgtgtgtacttatacatacgtgtgtgtgtgtgtgtgtgtgtgtgtaatcagtgagaacaactaaggacagtgaaagtaaattagctgggaaaagtggtatttaagagagcaagggtttaaaatatacacttcttaaatttcacccaggaccatttacttgtccattctttctacaatcaacataaaatttttgagccttcgtcatgcatcaggcactgttctagaccctgaagagacaacagtaaataaattgatgaaatcctttgtcttttttgagcttattctagtagaggagacagactataaacaagcaagtaaattgataatataccatgtgatgataagtactatgaagaaaagtaaagcaacatcaaaggataaagagtcctggggggtggctgtaattttagaaatgatggccagcaagtcctcccagattagttgatattttctcaaagagcaaatgaaataggtgagccagccacatgaatgtggaagaagagcattccaggccatagacattacaggcaaaggtcctgaggcaggtatattcatagaagagctagagcagagtgaatgagaaagacaaggtcaacaaggggatcagaggttaaataatagtaaggaccagtgatttgattcccagtgagttgagattccactggaggttttgaggagagatttgacttaaatttttaaaggaaatggaccataaactgctgggggtttactttaccatatagcataaaagccaaatatccattacttaaacccatgaagccttattttcctgtcacaaaaagttatttcagaggtgggtggttgaatgccttatcatggcaactccagagtcatcagggtcctgggtttgtcctattcttccgcttttccattctaactaacaagtagcatcatggtccaaaatagtggccgaaaatgttgctattacatttatataccagcaagtaggaaagagaaagaaggaagggaaaatagggtgtagttcctactgggtcatctctacttttggaaatttctcagatgttctgcagggtacttcttctatctcatggtaagcccttagccacatggctatgtctagctacaaaagtgttcaggaaacagagcatttcagctgagtactttgttgccaccaatgaaattagggttttactactaatgaaaacaaggaatctgaaatatgggaacaaaataagaggcaatttaagatggtctaggccaaaaatgtggtggttaagactaggttagtaccaatgaagtgttgctacatgggacacatgttgaagatccagccgacggggttcactgatggggtggtcataggaggtgaaagaaagaagtcatggatgcctccatggtttttggtctgagccactggatgtatacaattccagtaagtgagatggagaatttcctcaaactttgatttgtgtatatgttaatatctatgtgatcgcaatatgtctcagacacaaatgatctgcccttcacctcctctccgctctccaactctaatcttacacaactgacaccaagattaccccagtatacattcggcctcactgccagcatcacttattttagaaccagaagttttagtcttttacatttactttctaattatttttctttggtaatattacatgttactgccagtattattcttcattttttcttgtatttcacacaggaatcctaggccactcaataagcattcacaaattatctgttgaacaaaatttgatctgtgtccttgccctgttctcattctttctagaagttatgacctatatctctatgataaaaacctcagcgtttcactctaggtagctctgtcttttgccaacaactcctgtatcttattcgtgcagaaactggaatctactacttagccttacatcctacctactcctcctccccaagagaaagaagagacccttcagatgacttactctccctctccacaggatgagggtttgcctttccaaacctaactcacttatctaaataatatgagagtgaaatattacctaaaccagaaatgctaagaaaaaccactattggaggttggggcaagtattgggattgctcagatatttaaatccttaagagtgagaagtcaaatgaatgttatacttatcctgcctttctcctacacttttctctccttctgatgcctcttctctgttttcagcctctggtgctgtcaacactattcatgatttacctggaagtaacagtacatccagagatttagtaatccaagactttcagctgggaaacttctcccaaatggtagtagcaatataaggccaagacctttgaatgcctgaaggggagcccatactcctgcagaatttgattcatatggagaaagccctggttaaaggcctgccaagagtatcttttctctgaaatgaggctttaggtctgtaattttcctttgtcattgctggtccttaggtagttgatgactgtctatagtggcattcccatagccactagctacacacacacacacacacacacacaaacacacacacacaaagacagggcaagagcccaagctgacagaccattttatcccctaaagggcactaattaactgatttgactgaaaacttctccttgctatagaagagaaaaaaaacagcttccagaatagagaatgacaaaatgcctaaatcctgattcggtctaaaagagacaggtattaaaattccattagtttatcctctttaaaatattttatttttcccctcatgtagctatattcttatcttaataaggatgaatgtttgtgtgttaaatatatttatagtaaagaacagtgttttagtgcagagtttcatagagatccataactaatcatatctcccatgtaattttcatttgccaatgaacagaggcattttgataactattccttatttccagccactaaagtaggccatgatttttattctcatttagcagataaggaaagaaatgcacaaagaggtgaaataactgacttagccatttgaagatgtggtagtagggttgaaattcgaaatctcagcctcttccaacttcataaaccctagagctatatagccggttttgcaataagaaagcctatttatatgactttccatgggaccaagaagtcaaaaccacaacagggtaaaagcaggaagacatggctttcttggcagggtatttcaaaggcagcaacgttaaccaatttcagggcattttgctatattgtgggggctgtcctggataagcatgactaaaaagtgcttgaataaagaagcatattctttgagaacactgttaaccttcttgtttttgaaaaattaaactaatcaagctctgtgcttataatgagtccaaagaaaggcctttcactttgaaccctctgaccacttcttcctttacatagtaaaatttcagtttggtctgaggataaattgtcaactaagttctggaacttatccagaaagtttccctcctccatcccccctacaagtgatataatcatatagaataatattaccaacctacaaacttcacacacctttaatgtgcagtaagttgaggatgcttgtgttagtgtccagcagaagcaattggccattctccactgtgacgttgtcgccatcttgtggcagcctttcaggaaaccagctgtgagtcctggaccatctccggcagaactgtaaagaaaagttgccctggaaaacagagagctgggttggtgggttggttggttggttggctggtctgttgcttcgttggttggttcgctggtttgttggtttgttggttcattcattgtttttgggcgggatagtataagtattgaatcaaaatagaaacttctcaaagaaagtaaaattaatttaaatattttaaatgtctccataaaattggttacctctctctttttcatacaactaacctaaacaggaaaaaacatgagaggcaaaattatatttgaagttcttctgtgcccagcccctggaattctccaataacatgctggtaatgttttcttgccttttttttcccctctagcacaggccccattctacctaacagatgagtttgattccatttatttttacagatatgtattgaatcttggacaaaaagtcataaatagcctggaatagggagaattaaaatgttctgcttgatgggtggcattttgctttatgtaattggtatcatttttcactggctctactgccaagagtccctgttttataggaacattcctcttcctaagtgctcagatctatcctcccactcggccttttttgatattattgttgcctttccccctgtgcctggtgcatcagggctgaacaaagcccatgcaggcataggcagaatgccgactgacttcagatgacaagtaaatagtctggaacatttgagtgaggggtagggagctgtactgacagaagaagccagaaaaggaagcactccctctccaccccagccttcagtccctctctcagaacttttggctttcctgttaatttgtggtcactctgatgtcatacgttttttaaaacagggacataaaaatcacagaaagcaatattgagctcatgcaagaggctggtaacatgtctaaatgccttgtgaagttgtagaagtataattacgataaacataataaaatcacaatagagaaggtgattccttcaaggtaatagatatgacatgtataagccactctctccagtcttcttcccattcagattccaacaaatgtgaagcccaagttcctataaaaataaaccacctagaaggtcctctcatgatgtgttagaggcagatgggagaagatcattagaagggaaggcatgtttgtaataccgacaactacacctacacagagaatagtgctctatagtatttctgagatagaaaatggaaaattgtgttgccagaagagccgttacgttttccagaaaaagatacaaaccccaaggtcaacagtgctaagttgcagacccaacacaatcactgagaaggctttgcaatttattcgttttctacatctgcaaagaagtaaaagtctatgactcatcacaatttaagagatggaaggaaataaggcatagtgataaccagttccagtatcacagaaaaaagaataggtgatccaggagcatcgttgtgaactgcagtatctgtaggctacaaaagtaggagagaattttaactctagatgatttcactataggactagctttaggttggtaaaataataaacagtacttcttataaggctatatatattatacattcttataaccctttaatttactcctgtagaatacagaaagaggaaagggaggcaaatcaaaggaaactggaatgaaagaaggtgggaaaaacagagatggtaaagtaaactgcagaacagggtgaaccaggttatctgtagtgtcagctgcgagtccatgataaaaggacatttgaaaactcttggatttccagaagcccagagatggaaaggactctagcaaaatcctatcccataattttacagatgctattttaggcagtgttccttagagcttaataaaatgtagatttctctagtgtcatcatatacctgtgaaatcaaaagctcaagaattgggacccagagacctacaattttaatgatcctctcagatgacacttctgcatcaaaatttaaggatcaattcagagcaagggctggaggagaaggagatatatctttaaaaggaaccaagatgttttctccaaaccaacatccaaagcttagggtctttggccaggatcgcccaaagactagcaagctaggaagaatgatgtgttgatgaactgtaagaaatatgaagacttcagcagcataacgctttctgagacattaacctggtggtcagatccataacccagccacagaactatgaagaaaaccagggctcattacacacacagtaaaatgatcgggaacaactagacattagttagatatttaagtgggtcaaaggtagactatttcatggtgttatccattaattaatttgagaacatttttaaatttttatgattagcacagatatctgttatctagctctcaataagctttagagactttcttgctctgaagcacttgcttatgccatttgctgccttccatgtgctataacctcttggcctagcctgtcagccttcaaagattgctatacttggtcccaacccagtaggtggaaaggtcaaatactgttatctctactttccagtggagaaagcaaaggctcaaagtgtttaaatgatgtgtcaaagttcatagtgatggaggcaaactggagtcacaaaaaggaagctcccatctgaagtttttcccttaccatggcctctcccgggatgctctttcccaaaagatctgcatggctcactcccttacttaattcatgcctctgctcaggtatcacctccttacctgtattattatttttaaaaagcacccccaatcattccttcattccttctcccctaataatgcctcattctagtattaaataatacaattccttgcatatttggttatcacttactaagcttactcaaatgaagcagagacttggtttgggtcattgctatattcccacctccctaaaagatgtctagcacatagtagttgctcaataaatgtttttgaataatttattaaatgaatcttatacctgctggtgccatacatgcttttacagatatcacacacaaacacacacacatctcttcctaatgcaataggtgaagatacaggtgctaagaccttaaaaatgctatatcccctaggtcttctgaaacatttacatcccttttcgtgttttcaagctccatttaaacataaaccaaatgatgaatagtgctacttaattggaacctgagactcagattcgatctcataaaatcttccaccaattttttctttcaccttaagtttctctagtcaatgtggccaatttcaaatgaatacagatgtttaagcattcagtttcaagagacctaagtttccttgtgccctgaattccccttagcataacaaagatatcttgagatgtataaatgtttattgatgtactcatgcttttacacaaaataattactaaatactaaaaaatctaaaaattactgcagcatccactgcttaccagctacctggggaaatagaagagcagcatatctctatgattgcaagttatcagtgtaatccatgattacatgcacgttgccataagaattttagctctcctacattttcagttaacagagctggtgctatcattccctcccagggaaatgctccatgaaacagtgaggatggctcaccttccaacatcttcatcctccaatccatgtcactttgatccaatcaagaaaaaaaaaatgccaacagcattgattaaagattttgtgaatatatttgagaatgtctctgttgataccaacatatttttggtgaaggccatgttccgtgtcaacagcccagcttacttccacctaatataagctctttcctctatagttcccatgatgctcagcctttagctttagtgttcttcctggagataaacacatcactcattcttattctgcagatgaagaaaatcaattcctcataggcatatgggggcagccgtgaaaatagagatacaagaattgcccagaacgtgacctcatctttgcatctagccccaaataaaccccaaaaaaagcagaaaaaaactttcctgcctcagctaggaagcttatgcaatttgttttcttcttacagcatgtcagcacttctctgaacttcagggaatgtgcagtgtctgcaaatcttacatgtcaccttaaatgtacttgcaacaccaccagagttatcttgaaagaagtcattgatcagcaagttggaacacccggcaaagcaaagacctatttgtgagtgtatgcattgagctggggtggcagaggaggtggcgtatgggaatctctgtaatcacagtgtctcctggctgacaagaacaagaaataactgttctgacacctcaccaaaatgtcttcttcctcagcatccaaatcctggaaataggaaaagacaagtccctgtaaccattttctccactccgtatccttctttattttctccaaagcactcatctctacctaatacaatgtatactggtttataatcagtcaacccctaatagaatgtaagcttcacaagagtgtcttgcttttctgctgtatccctagaacctacaataatgcctggcatctattggctaccccaaaaatatgtttgaatgaataaatggtcaactcttatttggacttatgatgccataatgaaaaatctttaataactgaaataatatgatatgaagctataatttaattttgttcagttcttctttacattgaaatgttttaatttttacgaaaccaactttatttaccttttttgtgacattcttcattatgttatagatgaaacatcctctttcaccctgacataaataacacttatatgtccttcttgattggtgggttttatatctgcatgttactcctcaactaacttacaatttatgttgatggaaagttttatacttttttcttgtttttattccttgctatttttcccccaaatagctaactgattgtcttcataccattcattaaataacatttattctcccaattaatactcttggctattttaacagttgaattataatgttcaatgacattaaaccttttggccaattaaaatcccaaatccttttgtatgagctaatataaaggcgtttctcccaaataaatgtgacctcatccttgttcttaaggtacttatattatcatttagaaaaatacaaatagccagataattaaagtgtgattgattcaataattaaaggcataaccaagatgctatgggagttcagaggattagatggctgaccacagtggagatggccttgcaggggaaatcaagtgcattaaacatcgttttctctttttaatctggacacaacagatgacacaggctgagattatttcagctgattataaaacaaaagatagtgtagaaaagtcaactatctacaaatccaggattatgaatagagcccctaacctataatctaataactctttagggaccaaaaaggaaattgaattagtttggtataatttattcttactgacctcatgcaggctctaagtgatcactttcttttctcggtggttataaacccctcatgattacaagataacatgagaatgtccttccacactgcactgtgtagcacattgactactcaaagaaatgtcaacagtactttttgtcagagattcctgcccagttcaaattgaccctttctcatcattagaaaaccaggcaattcattgtcttatctcttggttccacacacttcctatcctctgcgatttctcaaaggttgctgactctacctcagtgcttcatatatctaagttattagccctcttaagcttcagaggattttcaaagtctgcagacaggacaaatttacagtcttcttttatcgtttcctctatttgaatcttcaaatctcctctaatagtatctcttctgaattttaagtccaaagaccttttcacttgtgggagaaaaaatgataatgatagctactgattacttaatatttctaatgtcccaagcacaatgctatacattttacttacagtatcactaatccttatgtaaaccctgaatatctgagacaggtctcagttaatttagaaagtttattttgccaaggttgaggatgcatgcccatgacacagcctcagcaggtcctgatgacatgtgcccaaggtggttgggacacagcttggttttatacattttagggagacatgagacatcaatcaatatatgtaagatgtaccttggttccatccaggacaacttgaagcagggagggggacttccaggtcacaggtagatgagagacaaatgattacattcttttaagtttctgattagcttttacaaaggaggcaatcagatctgcatctatctctgtgagcaaagggataattttgactagaacggaaggcaggtttgccctaagcagttcccagcttgacttttccctttagcttagtgatttgggaggccccaagatttattttcctttcatactcacaactaaaaaatgtaggtattactctttccacttaaagtttaattaataataatggccaacacttacggggtgcacttaacaggtattatctcattttgttacagactcttttcagactactttccaggaactacagagtagatggatccctgccttcaacaaatgtttattgagcacccactacacaccaggcacaaaacaaattcctgacctcatggagcttatattttagggagataacaggttaaatatataaaactaatagtgtgctctgaagtaaaaaagaaacagggtgaagtggatcagaagtgccagggtaggaagagctatttgatatggagtgatcagagactgctctgattggattggattggattggattggattggattggattggattgggaaaggagcagagaagtagagtatgagccagaggctatcaaaggaggaccttgaaaaaagggtgtgcttggagtactgcagctgcagcctgaaggatcaggcggctggccctggaggaaggaacgctgtatagccagatggcctttctagtgatgcaatgagaaacactgcacaaagacctgggtagacatcaagttcttcatatgtcatagaaaaaaaaaatcaaggaaaacactcagtaacatataacgaggtcagcaaactacagtccacaacccactattttgatattggcacacggcatgacaattcatttacatattgtttgtggctgctttcagtttgtgacagaagcaacatggcccacaaagcctgaaatatttactatctggctctttataggaaaagtttggggaccccggtaaattctgtttcatactatactatcagtatagtacctataatatgctcagtatagtgtatctatagtacatcagtattaaaacatgcgcaaaatggaactttctgtaattgaaaataggtaattataatacagctacctgagacttgagggactgcaaacaaaaacatcttagtgaaggatatacattaaagtactggaaactgattcaattcttcccattttttagtacacaataagccagatctcagaaagccacagaaaggcaagtggaagtgtgggaagttgtgtgtgtgtgtgtatgtgtgtgtgtgtgtgtgtgtgtatgccactcacgcactcacgtgcatgcacatgaatacacacacacacacacacagagccagatcagaagattgacagatacatgctagcctttttcacaagctaacacactgccatttaaccagcgagcatggagcacgtgtttgtgttcccagtcactattaagagacaaggttaacattttaagtgatggactacaacatgttatttccccatgcaatggacccatgacggcactgccttcgaaaacacttaatttcggtgattgaatacacaggagcgtactttccctgctatgaacgtttgacagctccgcagtttcatacaccaggaaaccttttttttcctcctttgcttttttcctgtctttacacctgaagggaagcaaaatggatatgtggtggcagaggaaaaaggaagaagcccagagaatgaaaaccagcttatgagcttcagtgtattttaaaataaaagtattcactgccatctgctctaattacttctaatgtttgggctaccatcttcatacaatagaaataatgatctcctcaagggcaaaaaaaaatttttttacagaaacaaacaaaagttgattacatttagctcccaggctaaagaagcatcaagctactttgtagtgaacaatcaattaggagaatgggtaggcctccgattaacactaacaaattaggtccttttggtggttccctcccttttcttcttttcctgcctctttagaggagctgtgctcacagctcactgagggcaaagagctgactaggcatatttctggatctagggttattccacacaaattccttacattttgatcagaaccagataaggccaagtcttctccctgtcttcttgttgacatcagacatgtcccagctttaatactgaatatagggctgggtattctaccaagacttcggattacttcatggagtgaactgcttaggggccaccccagacttgaactcctctaaggaagctaaagcccacttagcctcagtaaagtctccaggaacagacatgatccaggccaggtccattccttagacttaagtgaaacacatggagcccagaaaaacatggaacagacttctacaatgccagcaggagaaacgttgctttcacaaaggctgagtctagtgaccttctcaaatcctcaaattcaaacatattacttgtatgaagcagaattctgagatgtcctaggattctgaacccctggtgtacacaccctgtgtagtcctctccccttcagcagaagtagagcctgtgaatatgatgggctatcactcccatgattaggttatgttatatggtaatgatgatagaattatgcagatataattaaagtgagagatcagctgactttgagttattcaaaagggagatggcctctacctaatcaggtgagtccttaagagagagattctcccactggccttgaaggagcaacctgccatgtggcttggaggagaccatgtggctagaacccaagaacagcctttaattgctgaaagtggtcacagccaacagccagcaagaaaatgaagacctaaatcctatattcacaatgaattgactttcactgacaacctgaatgaacttggaggtagaccttgaattccagatgagaatgtagccatgctgacactttgatttcagccttgagagaccttgagcagagaacccatctactctgtgcccagactttttaaaaaatttttttaatagatttagagggtacaagtgcagttttgttacatggatagattgcatagtggtaaagtccgggcttttagtgtaaccaacatctgaagagtgaacattgtgcccattaagtaatttcttgtcccaccttctttccaccctcccacccttctaagcctccagtgtctattattccactatatccatgtgtacacattatttagctcccacttataagtgagaacatatggaatttgactttctgagttacttcacttaagataatggttccatacaggttactgcaaaagccatgatttcactcttttttattgctgagtagaattccaatgtatgtgtgtatatatatgtgtacacacacacacacacatatatatataaatacatacacaccatattttctttatccaatcatttgtcattggaaacttaggttgattccatatctttgctattgtgaacagggttgagataatcacctgaatgaaggtatctttttgatataataatttcttttcctttgggtagatacccagtagtgggattgctagatcaaatggtacttctatttttagttctttgagaaatcaccatactgttttccataatggttctactaatttacattcccaccaacagtgtataaatgctcccctttctcagcatcctcaccaatatctgctgtagtttgactttttaataagagccattctgactaatataactcggtatcccactgtggttttaattttcatttctctgatgattactaatgttgagcattttttcacatgcttatctgccatttctgtgtcttcctctaaaaatgtctgtttgtgtcctttgcctactttttaatagggttgttctggtgttttgtttgtttgtttttattgagttgtttgagctccttgcagatactggatattagtcctttgttgtatctgtagtttgcaaatattttctactgttctgcaggttatctgttcattatgttgattacttattttgctgtgcagaaggtttttagttttactaggtcccacttgcttatttttggttttgttgcatttgtttttgaggtcttggtcataaatactttgcctaggccaatatccaaaaaagtttttcctaggttttcttctaggacttttatactgtcgggtgttacatttaagtcttcaatccatcttgagttaatttttgtataaggttaaagatagaggtccagtttcatgtgcctgcatatggcagtccaatttcccccgcacacttatcgagtagggtgacttttccccactgtatgtttttgttggctttgtcaaagattagttggttgtagacatgtgactttatttctgggttgtccattatattctattgatctatgtgtctattttaataccagtaccatgctgttttggtgaccatagccttgcagtataattcgaagtcaggtattatgatacctccagctttgttctttttgcttaggattgctttggctagttgggcagttttttggtcccatatgaattttaggatggttcttctaactctgcaaaaaatgatgttgacattttgatagtaattccatagaatctgtagattgctttcaatccgtgagcatgagatgttttttccatttgtttgtgtcatccacaatttctttcatcaatgttttgtagttttccttgcagagatctttcacctccttggttaaatatattcgtaagtattttatttggttttgcatgtgcccagacttctgatctacgggaccatagataataaatcggcattgttttaggccactaagatggtggtcatttgttatgcagcaacagaaaattaatatgccactataaggaccttcttgagagaacagttttcacagagaccatgtttagatttttccctctttattaaagttactgctcaaaagcataaataacagcaagaaaggtgggatgccagtgccaggcagaaggacaggttattcgctcactgcataaactctcctcacacaggacatgcaacatggaatttttcaatttatgatgccaaaaaatgtaaagtaagacctgatgcagacctttcttttgctcaggaagaattatgactaccaaagatatacagtaaataccacaaggacttctatgtagtcaccaatacttactatctaggctgaagaaatgaaaactttctgatcctgaacatggccaggatatgtgtgcttagggggataacgaagttttttgtttgttttttgggttggttttttttgctttttgttttgttttgttttgttttgttttgttttgttttttgagacagggttttactctgcacccaggctggaatgaagtggtgcagtctcaaatcactgcagactcgacctcctgggatcaagcaatcctcccaccccagcctcctgagtagctgggactacaggcatgcaccaccacacccagctaatttttgtatatttctgtagagacaaggttttgccatgtttccctggctggtcccaagctcctgagctcaagcaatccgtccagctcggcctcccaaagtgctgggattacaggtgtgagccaaccacacccaggccaacatgaagaatttttaaaggcccgtattctgactctatgtctgagaatgatatttgactatgattggtattaaaaattctactcttccactagcattgcttcctgagaaaagaggattttcttttttttatttctcattttaaaaaaagaaagataaggcaacaagtttcagggaaaaaccaagctcaggaacaagaaaaactcattctgtacctatatcttcactagccttgactaaataactttttcctagttctttaagcttcacgtttgaggtactttttagagagaaaaagaaattcatttgtttatcctcaaagcagcatcatgtgttcttaagctttctgcatgtattgcctggtatttgataatgtgcaaggttatttgtgttaatgctaataccacaaaattatcaattgtacctgaagaatgaggaaacccaggaagatgtttcagaggtggggatgaaatctcaataacctagaatttgagaaacttgcctatgcaatctgatgcagatgctttccttgtacgtgcagattttgtagaataaaaccatcaccctcatctttgtgaacatttactgggtgctcactctgagccaggaactgtgggacctagccttgtctgcatgaaggcataattgaatttctaagctcttagagcccagtttcaaatgcattgttccctttagcccaaacacatccgccacacattgtcccttttctgccaaaccctgtttattggttccaaatgcaatgaatcatttactgacttgagcaacattagaggtaaacaccaaggttaaaacgtagagataattgaataacacaccaactaccagtaacagcagtccaggcaaaagaggaaatagatccagagatttcagaaagggcaatctgataggaaccctccatgtcaggatcaaaaccgcatgccactttgacatgacagaaaaaacatctgcattttatttttttcaaaattgtatgtgccagttattaatatgggaagaagcagaaagcaagcaggtggtaacataacttaaataccccagtgattaaaaataaaccatccaaaaatcaactatcatgtatttagtataccaaaacagtggtgtaaagctgggttttttaaaaaatatatgtgtctgatttattgctttcactgttgatgaagaagattaataaaatatatgcatttcttttgcagtacacttttctctggagaaaactccagaaagcaaacattgtccaaagcccttccaaaaaatcataaagctcaatataacttccatatagcaaaatgcactttaatcatttactttacagtcacctggaattcattgtatgcaattcacataatgtctaaacttgggcatataacatatacacatacgtttataccaaatttcctttttacgtgtcctcaaaggcagaaaactcagaatctttggtgaatactaagcaatccacaggcacagttttttcccaggaagtccctcatagtttggaaatccaaaatccccaaagaccctcatgaaacaagacttcaagtgcaatagttaactaccttgggattcaaggctgaatttactcaataaaccatactaaaggtttatcaaagaccacaacacctctcagaaacatgtgcaaaatacattttccagaattctcccaactttggggaattacacccttgccaaaaatgaattgttcaacttgctgaggattaattatttatgtggctctgttttgctttaagaaaatagagatttcttttttccccgttttcccaactagaagaaatatagctcccaagaagcctctgtgttatagttcagggataatgaaagcttagctattggttccaatatctcattttataaatgtgaaactcagtgactgatacaagattacccaatgaattgaataggggtaggtcaggacaaacaccaaatcaaagtgatttttggtcttttaaaattttcttgatagagcaatcactattcatcccagtacgggtgaatcacatcacagaccccatgaaaaagggggcaagcaagaagcacagttttctattattctaccatttcccactcattgatgaccttctgatagccccctctccagaagaagtttcccttacctgggatgtacctaaagtagtgtttgtttgtttgtttgcttgttttagaaaattgagaaagaaagaaaaaaaaacattttttaatcaatcaccatgaaccagaaagaattaacttaccttcttactcccttcttatactcagcctctctcaagtctttaagcttctcatctgggcaaaccaaagcaaacttaaaccatgcttagtttaaataattattttaaaccttttgaacagtttgagaatatttaatgacaatgtaataggcatagactgttgaaagcttgtcctgttccctaagcaaccaggatgataagaagacacccaaagtatgtttagaggataggaggtcaatgtagaaaataaatgaagcttaacctggatggagttggagaccattattctaagtgaagtaactcaggaatgaaaaaccaaacattgtatgttctcactcatatgtaggagctaagctgtgaggactcaaaggcataagaacgacacaatggactttgaggacttggggaaaagggtgggagggagtgagggataaaagactatacacattgggtacagtgcacactgtttgagtgatgggtgcaccaaaatctcagaaatcaccactaaataatttattcatgtaaccaaacaccacctgtttcccaaaaatctattgaaataaaaaataaaaataatagaaagaaaaggagattaggacacagatacagaagaaagaccatgtgaagacacaaagagaggcagtcatcagcaagccaaggagagaggttcagaagaaatcaaccttactaacaccttgatgttagatttctagcctccagaatagtgagaaaataaatttctattatttaaacaacagaaaactaaataaataaaatttaaaaataaaacataaaaaataaaattaatgaagcttcattacattttgcatattaagcaagaaaattgaattttaaagatagaacttaggctaatttataattcacataaaagacgtttctttgtttttacttaggagaaatattaatgatattgtatttgacaatgatttcttggatatgacaccaaaagcagtacaaaaaataaataaataaattggacttcatcaaaattaaactcttttgtgtatcaaaggaaatcatcaatagagggaaaaagcaacccagggaattggagaaaatatttgcaaattatacaactgataagagattaatatccagaatatacaaagaacttccatagctcaacaacaaccataacaacaaaacctgatttttaaagtgggcaaaggacttgaatggacatttttccaaagaagatatacggatggccaataagcacatgaagatgttcaacatcactaattatgaggaaatgtacctcaaaaccacaagataatactttacatccattaggacagctatcagccataaaaaaaaaaaaaaacaaaaagaaaaagaaagtgaagtgcagtgttgcctatagtcccagctactcaggaggctggggcaggaggattgcttgaatctaggagttctgagctgtagtactgcactatgcactaagcatgtctgcactaagttcagcatctatatgggacctctccagagcaggagaccactccattgccaaaggagggatgaatcgacccaggttggaaaaagagcaggtcacaactcctgtgctgattacgagagtagctggagcctgcccatgaatagccacagcactccagccgggataacatagcgagaccctttctctaattaaaaaaaaaaaaaaaaaaaaaaaaaaacagaaaacaactgttgccaagactgttgagaaattagaaattagaactcttgtgtattgctggtagaaatgtaaaatggtgcaatcacaggggaaaacagtaggacaattcctcaaaaaattacatagattataattcagcaattctgagtatatgctcaaaagaattgaaagcagggtctcaaagagacatgtgcacagctatgttcgtagcagcattatttacaatagccaaaaggtggaagcaactcatgtgcattgacagaggagtggacacacaaaatgtgatatatacattcaatgaaattttattcagccttaaaaagaaaggaaattctgacaaatgacacagcatggataaatcttaaggacaatattatgctaaaagaaataaaccaaacacaaaagaacagatattgtataattccacttgtataaagtgcctattagtcaaatacacaggaacagaaattagagtggtagttgccaggtgctgggggaaggaggactagggagtcattgtttaacagattccagtttgggaagacgaaaacatccttgagacggatgctcgtgacggttacgcaacaatctagatgtactaaatgtacacttaaaattagttaaaatggtaaattttatgttgcgcatattttaccacaattttgaaaactgaaaggccaggcacggtggctcacgcctgtaatcctagtactttgggaagccaaggtgggtggatcacaaggccaagggatcgagaccatcctggacaacatggtgaaaccccgtttctactaaaaatacaaaaattagctgagtgtggtggcacatgcctgtagtcccagctactcgggagactgaggcaggggaatcacttgaacccgggaggcggaggttgcagtgagccgagattgcaccactgcactccagcctgggtgatagagtgagactccataaaaaaaaaaaaaaaaaaaacctgaaaaaagatgtttctccatatttgataaaatcaatattcttgggttctgtaattctatagatcaaaccctcagattaaaaaattaaacttacttagtttgttcagtgcttctctgtaaagcctatttggaattggggaattttagaacatctaacatcctcatttttcagatgagaacactgaagcccagagaggtaaagtgtctttctcaaggtcctaaacccaggtgaaagaatgagaaaacagaaaagaaggcaaccctcagtatatatgcttccctcattgctctgtgaagggtgggtttgcacaccttgtttctgtgtgtgtgcatgtgtgtattcacaagccctgtttacctgtccacgctactcccctactcccaacctgaaaacttacagaaatcacctgtagtcttcagatacactctgctatttcatgtcccatgccttcatttacagagcttgcctccattagcttcatcgagaacagcctttcacccctgttctaccagacaaactcattctttcaaagccaggtcattcctctttcttccagaagcttttgatattgtcccctcaccccaaagcagagctaccctcacccttcttactgcttccaccaggctttgcacatactgctgtagtccttaccccacactgccttacgaagtttagtatattgtagtattttctatttccactctctaagccagctccactacctaagccagatgagtggagctgcaagagaacctatgggagagcttaatggaaaaggcactagtatttgattcccacctggaaagtctaaagacaagagactggctggagctgcccttgcccagtggcagagggaagagggggcactggtttgggggcaagctacatgtcacctctggagagacaggcaaatgtagatcccaccaaagggaacaagctgatatgacttaaagagatctttcccaagaggcagactggattggtgagggagaagcaaagctcctcaccaccatcctccccgcaaaaaaatgggccagccattcagagagagttgcagacctaagatcccagcaggaggatctataatgaagccacagaaaatcccataagagagagctgcacctgccacacatgatgtctcctttggccctactcatctctcctctcaggccaactcctagaggaaggaaggaaggagatggagagaagagagaaacagccattccccaccccaccccacaccaaggtttccaagccatctaggggtgaaggagccttttaaaattagataaatttgggggtttcaaaattatattggactgaattggagttaagagattattagagcccatcaagattaatgtgttcaaaacacatcataagataaggacttcaaagtagtctttgaagactacctcagccaggggcatttcagtgttcaagggctgtcaaagccaaggaacttgcaggggatggactagaggtgaggaacaggaaacacccaatgtcactaggctttcaacaaacatgggctgtgagggaagaagaaactcagttacatgctaaaaggggccataaagtcaacagaggattaggggaagtttggggttctttatttaagattaaacagtttatgaactgagagaaatgcagaaaagagatgaggccgttttgacatcaggtgctaccaagcaggagaggaggtaatctagaatacaagtagggatcagcccccttctctgctcatctcacaaacactgtaagtcccaggcatacgtcctcttcttcctcatctgcacattcttcctggatcctgtcacctcctgtggcttctattatcacctacctcataacaattttcaaatctgtatctcaaactctgaaccgaaaggtttgaactgaaggagaaagtgtctcaactctctcctaaactctaaatggatggatatctccatttgtatgttaactggagcactcagccataacatgtgtataatgacattcattattttcccctttctacaaacttatttacttagccattaatatcaagtttacagagttaccaaacaccaaaaatagaatcacctgacttgtcccgtccttaatccccagcgtccaataggtaaccaagttgtgtccatgacctcataaatgcctcttcattcattcttttcttctctatgtatgcagttacatagagaagaaaagaccatacagaacatacagagtgtgtctgaagactacaggtgatttctgtacatcctcatgtaggccttagtttaagagctgctcatctctcaccaggatcttcttgactgtaggctccatgagaacagacagcatgtctgtttatgcatctagggtttattgcagcacttggtacatggtaggtttttaataaatatttattaaatgaatgaataaatgttaaatggacgaccattgattgcaacagccattctgatctctctgcttccaatccccccacatcctttcattctcctctgcattgctaatattctcttcctaggaaaattaacctcactcattcattctctctctgtctttctccctctctctctcctcctcctctccccccaacacatagtcacccacacatacagtcacccacctgacctgcctcccacacacacttagaatacacagagtgtagagcttagaaaagagctgactccagtgcctagagaacaaagtccaaattcaaataagtatctaatcctctaccctacaagtggtctcccagcctcatccctcgcttctccccataattctgctggatcatgtgccatcctcaagctataccaaaagccacagtgtcccctaacataccctgacttgtatgcacgtgttttttctctcctgagcagtccagttgttttccaaggactgtctccatttaaaatctctccagaatgatcttcttggaccctggagaagctatcttctctcagtgctgccctgcgctcagtgcccactgcttttgtgctccatatttacatcaatgtttcaccttgctagagtgtgagttttaaggacaaggactatatggtagtcacatgtatattacaagtcactagcacctctcctggtacataatgagcacttgccaaattaattagaccaaattcatgaattagacccatttattacccgtatgtaacaagcaacaaacaaatgggggatgtcagtgacaccaaaatgctttctcttgcctgaaagtttataatttctttgcactctgttaaaactatttcgtggtttttttcaaatattatagaaaatattcatcaaggtataactcaaactcctgccaccatgtctgccagcagaatgtcagtagacctgcttcaataaattgatagcacttatttataatttgcagcccccatttgcatgcaaataatgtgctacagttcataaagttgatttttctcttaagttaaatattctacctacaatgttgttcatgtatcaattaatgaagttttactatattcaacccataaacatttattgagccaggtactgtgctagacccttaggataaaatgacaaataacataattccctgctctcaagaagctcactgttgaaaaaaaccaacacacaagccaagcattacaatgagacaggcttgtttcttttcttacaagggcaaaatgtggacgtttacaagagaaggtagagaaaatgaaagctaaaaggtagcagttgtaggaatacttatcagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggcaccagaggattgcaatttcatccagcatgatttttattagccttgcaatttcttaatgggctcccctgagggctggctggtagaatcctgcactaccagtccggatttgctacaggcagcttaataaacatggtatcttccccgtgacaattgtcataacatctgaccagggtgcagaaggcagagctaaaggttaacaaaaccactgctcaggtggcagggaggtgagtggggagaatgttggaaattgtaatctgaaggcaaaggctgcctgctgggttggtgattcttccagcctggccagagctcccaggagccgagcaggcagcttgctgccttctataatcagcatcttttacacatctcatcagtgtcactgttcctgacgtctcattatgcaccagaggtggaagtggacaggtaccgaacacttgaacttttacttttcttattatttccatggagcaccatgaagctgggagttaattaagtcccgtgggacaggcaatcagtgtcttttttgctaagttaaattacattatacacagatgcaaaaaagaggagaaaaaataatccctcagctgtttcctagttaatagagtaagttagaaatatgatgatgccaaactggaagctgaagttgatagctccttagcatacgaggtgtctaatgaagtcatatgacaaatccaccagggatctccttccttaaaggatctcaaagcacttttacaaacacttttaaagaacttcctgcctcaactctgacaaagttaattgggggatgatagtcaattcgatagtttagggaggaaattgtactcagccagactggagaagaaaacttccttggatgtataagatgttagactgaaaagaaaccttcagaggtaagacagaatcagacagtgtcaaagtggaaagggagctaaaaatgacctagcccaaaatttcccaaagtgttccacagagagccaataggtgttgtatggaagaaaaaaaaataagatttttatgaccaaataagcttaggaaagactggtttcaacagagtaaaactgccttccttcctgcaggactctccaagcttttaatgtctgactggacatcgatagaatcgagtctgcagcattcaccaaacttacttcactacagaacactttttttctttcttttttttttttttgagacacagtctcgctctttcgcccaggccggagtgcagtggcactatctcggctcactgcaagctccgcctcccgggttcacgccattctcctgcctcagcctcccgggtagctgggactacaggcgcctgccaccgcgcccagctaatttttttgtatttttaatagagacggggtttcaccgtgttagccaggatggtctcgatctcctgacctcatgatccgcccacctcggcctcccagagtcctggggttacaggcgtgagccaccacgcccagcccagaacacttttttttctaatgagacatgtttctttactaattgcttacagaattcacattggaacatgttgattttgtccagttacagatggggaaactaagaggttctttggttttgtttttttgggtttgttgttgttgttgtttgtttttttccttgagacagagtattactctgctgcccaggctggaatgcagtgcagtggcataatcatgactcactgcagtctccatctcctaggctgaggcgatcctcccacctcagactcccgagtagctaggaccacaggcacacgccactatgcccagctacttttttgcattatttgtagagatgaggtctccctatgttgcccaggctggtctcagactcctgggcacaagtgatccaactgcctcagcctcccaaagtactggaattacaggagtgagccatctcgcccagccatgaggttttccccagacgtgcctccaagcacacaggtaggtaacacccaagccttgaattaggacttagatcagccaatctcagaccactatatcataccacctccctctgtaacttaccaggaatctaaaacaccctacaagaatcaggtatgctctctggtcaccctgcgtttctttgtattactttcagaatactcatccttcatcctttttcacctgcagtcttaagacacctcatttccttatgttctcacccctcgtggaagcactgcctgtcatgtaatggcatctgagctccaagagaacagcagctacatgttttagaactcaccttacctgccatcaggccacagctcagcaagactagagttctgactctgatatgggatctaaggagcattttatgagacacagtggtggcaacaaaatttataaagcctctaacagctttattttcctcctgaattaaatctacactccttagtttggcactcaagattgtacatgatgttttccaacctttgtttctagtaactgccttcctggttactttctttcaaactttacactccagccaaataaaatcacttaaacgtaaaccatgttttcccatctctgggactctgtaagactagtctcttagctagtagacctttgttccttatcttcccttatccacatcctggtaatccttttaggccctaataaaatgccacactctctagggagtttccaggtaatttttccacccagaagatttctttgccttcactgattttccataacaaaatacacatatctttattatcacatgattatattttgcttatagcacagttagtgagtttttatatctcccctattaaatagtacattctacgaggtaggagttgtattttatttctctgtagacttaaagcaacctcccaaagtccaaagggatggactagttctaacattctagatattgaatgcataattttatctaggcccttcataacttcatagtttttggttgtctctcaaaacaatcatctgaaaatccctgggagggactcagacaatgcctgggaccctctgagtgatctgtaaatcatgtttcagaaggattaaagaacggcaatttttttttttttttgaaatggagtctcgctccgtcgcccagactggagtgcagtggtgcaatcctggctcactgcaagctccacctcctgggttcacaccattctcctgcctcagcctcccaagtagctgggactacaggcgcctgccacgacgcctggcttttttttttttttttttttcagtagagatggggtttcactgcattggccaggatagtctcgatctcctgacctcatgatcctcccgcctcagcctcccaaagtgctgggattacaggcatgagccaccgctcccagttgggaagtttaattaatgtttgtatagtatttggggagatgaattatgagaaaccgacactgtaacagactatttctttccctagattgctcttttctttattattagaggaaggttctcttgcatagaactgagtgatcagccatccccgttgggagctggtacatcataaaaatagctgctgtcattttgaaacaggaagacgcacatcacaaaagaaacacctaactgactttaaagtcctgcgggccactgaagatatgtgtgttttatgtagtcattatgctttctcatttggttgtttgtttgttaaaagcagacattcctactgaattctaagggagacttaccaaactgtttccttttcatttacctgacttatacagaaaaggtgacttgttttcaccccctcaaaatctcatgcaacagcaaggccttaagttagcaaaaggagaagtgaggagcatcagaggaagtggccttagtgtagctataaagagaaaagcaaggtcattgaggtcaagtgtttgctgacggcaatgtccattctccagctttccacttatcaacagcttcaagacttaccttccaggcatcactgctaccatatttttacccaggtatttgggatgggattagctctattctataagtgcacagtgatcactcattggccaaaaccaatcaacaaagcccattaccctgagcagagggaattttgcccaattaactcaagttggatcaatgagtcatgaagacatatttgttggggggttctggggaagaaatttccttcttctgaactgtgctcatgaaagaccctttcattcccatgtgatacgaataggaaagcaagtaggcctagaagctactgacaaccacattgtggccacagagaaagcaaccttaggttgaatctgacactctgcaaggcagggaagagacatggaaagagccatctcattagtgagccctgagctgctggatcaagccattcctatgactccttagttttcctgtgctgtgagccagtataacatctttatcatcggttctgtgagccaatatagtctctttatcaaatgatttgagtcatttttcccttgtgatttaagtcttcataacaaatttttttaagtaaaatttaaagagaaaaaatgaaagagcataagtttggaagctatctataaacagattatagagagctatggaaatggatgtaaaatatattctttatttgaggaaagtttcttgatgcacaatattccagtgtgtttcttagaaggaaataaatagagacttagcacaggcagaaatgccaagaatagtcatgtctccccagaaacttccactgtttgcaacaacattacaaagaaagtgattaatttctcagtactagaaaatcccacagaggatcttcagggcatcaggactgcagatgagggtggaaacacatcaccgatgacatgggaggagagtgggagtccagaggatgaaaagaggctgaatgatatcaaatgtccagccacctttcctcactaagtcccatcagtcgtttctgcctaatggttccatctcatagcttaacttgtcatacttgccatcaagaatgtaaatccagttctgattccctgtagactcacagaaaaactaattaaagacaccatgtggaatagagtgggtctgccacaaggctgcagagccacttgttaaaaatggtgtcatcagttaagtctggctagattgcacgtggcgataaataatcccaagttttcagcggagcaatacaacaaaagcttatgtcttgttcacacaacatccactacagatgttggcaaatctcttggacagaacaactgtcccccatatgttgaggacgtatgttcagcccacactctgggctatttagtcaacacagaaaaaaaaaaaaggctagagatttgagctccagaaattcagtgcttctacccacattctatacaagtcctatggccctatcaaacttcaaaaggctgggaagggaagtgcttccttgacctcaaaataaagaactggatattggagatcactgtcacagagggaataactgcaaagctgctgcaaattctcttaggtaaaggagaaaaggagtctaaaaaatcaactaagtatccattaatttgaggaggttactagcacttaactggaagtaagggaactcttcaaaatattccaagttattctgcatctcccatcaaagggagaacctgagaagactagtttagtaattataatattctagaaaggagctagagctttctttgtaaaacctatagaatcaaggcatgcctttcctgttgtttatttgtttgttttattgtttattttgtttggtttttttccctttttttaatgtatatacccttcagggtagtttattccctcattaaatggctacttttctcttttatcctctagaaaaaacacatttcctttcttctggtgtagctgaaatgatccattggtgtgtattttatggacaatatcttctcatctgcacacttttctgctgatttacatttatgttggctccatggagagatacaaccagaaagggactttgtggcattgttgggatatccacaaccctgccactagtctaccatcagctaactccagccaaggacagccaggggactagaagaggtgttgcctaaccctcctaccagcaaagcaattcaagaagacagtaactaaaataagctcttagaggagttgtgcctacacacccttatttgacctgcccgaggagattagctcaaagctggaatgcaccagtggaaaaagaacagaaagtggaaaaagcctatgcctgaaactaccattttatagagttaatgcaagttaacatccactcatacatacagtaataccattaaggtcatttctatctccaagtaacagcctttatctaaaaccagttcaatattcttcattcctcccaatgctcctgcctctcccttctggttccccttcttttctcctctaactccctgagacacaggagtttttgtttttgttttttttctgagctgattttcaattcgatgaagtccgtttccataacacttttaatatctgaataacccattcatctttacccaaatttcttcaccttccaggctccagctgctctgcgctatctggtcaaggttccctacatttcctaataaagatgtgcatgttaggagcagttactgtggctctttaaagtaagagcagacttcagtgctgtgggaataaaagcaaggtctttggaggggaagatttatggctgaatcaacaagaattaaaaagaggacaaccctgaggagaaaacccaagttctccaaattgactgaattgccttttgtatctcaaggctgagatgattatttgtttttgcaaatagaaatgctatgtatattagactcaaaactgataacatattagagctttcagcaaaataaaaaatgtttaacatgtctagtatagaaccacatatccaaacactgatgaaattcatattactccttactcaacacaaatacacaacacataccacaaccaccaccactaacacaccacaccacatataccactgaaacccattcaactactatctgagacccttcatacctgggaaaggaacctactcatagttgggtgcctttaattcttcatcaggcttcagggagatggtagtttactactatgcattcaagaaatggacctgtggaaaagcaagcttttctcgcacatgaagaattaaatatactgataaaataacatattgacatatcacagttttcacattctgttactaaggacttccataaaatctttccatgtcgctggtcgagaaatagcaacttgagattacaaaactgagttatccagtcacccaatgagtcagcaagtaaactaatttgaacacttctggttcttcaattaccaagcctcacctcccctgtagaatccaaagaatccccatgtgaggccattgtaccatctatagcaatttcatagcaagcaggcctctctgcaggatagctaaagtttcatatttggaaaggctcagaaaaaaaatgtaagcattatactcctatagtcaaaaacaaaaatcccatgacatatggtttcattgagaaaattacacacagtatttatttagaaaaaaataatttcaatttatgaagttgtactttagaaggaaataaataatcatgtcacattccaataggactaccttttgtctgtcattcatagggacattttcacagggctaataaagctcgcggttttccactgagcacagaaactgttattttaagataaaagttaagagtagtgtagctgagataatgcaaactcctatatggtgatgtaataattactcagtgatattataataaatttaaacacattgtaaagaaaaataaggacttttgggagccaaaatatgacaaacactcatcaaaaccacagccttatttactgataacatatcttgatatgagaggagcaggctaatatcataaactcatttgatacaaagagtccctgagaaacaaaagaggcacaattaacttgttcagatgagtttaagctgcattcaggctaatttcctgaattccctctttttttccaattagatatatttttatttatgtgtttgcagagtgtacagtttcaaacacaccaggggactgtacctaaatcatttttataatatcatatttaatgggaaattcaaagttgaattattttaacattgaatacagaaacccattcatatgattctaaatacttttggcatgaaatataactgtgtcattgctgaatagttaaaggtaacagtttatttcatattattagatatagcagacctgccattccatttctataaaataaaaatgcattataatgtttacattgattaataataataacaatacattaatagtagtaacaacatattacctaaaatcattggtaataatgtcctagggcaagaagattgtacaaacctaagaactagattttctttcaaatctttcatcatactcttgagagaaagacaggggaaaaggcaagaatttcttcctttttttttttttttgagatggagtctcactttgtcacccaggctggagtacagtggtgcaatctcagctcactgcaagctccgcctcccgggttcacgtcattctcctgcctcagcctcctgggtagctgggactacaggcgcccaccaccacacccggctaattttttttgtatttttagtagagacggggtttcaccgtgttagccaggatggtctcgatctcctgacctcgtgatctgcccacgtcggcctcccaaagtgctgggattacaggtgtgagccaccacgcccagcctccttcttttttaaaaaaagaaaaaaacagcaagaaacagaggtatgcaaagtcttaagttcaaataattgacaaagcctctttcacacggcaagttctgattatgacaacaccaccataaacaattatataaattgtgacactttaacttggcataacaatttacagagtactcacagactgattatctttcataattgtgtagtctcattatgtatttaaccaaaaatgataatccctggcacatttccagggctgtctatgaatgagacactgcgttaagtgcactacatgcattaattaattcttacaaccctacaaggtaggaattaacagactcagtgaagttaagaaaatttgcccaaagttatataacaagtaagtagaaggatcagcctcaaatccagttttattttagagtccaagctcacaactactatatcataatgccattgttgaacttttaggtttctcctactattatacgtttataggtactgtcttcctccctccaaaagctggaagtcagctagtaccaatcaattgaaaggttaagtgagttgttaaacagttgtagtcagacagggacattgctggaattagaagagaggccccaggagtcctgttcactgtgcatcctattctgactaattaccctaagaaggcaaagccctttcagatgtgaaactgtctgcctttccagcttctcctccccctgaagtaggtaattctcatacatttggagcctcatttcagggagaaaatacaggcacaagggactcagtaagtttcctccaggacagccaggtcaggggtcaatggttgagtttctataccccttttccctaatctaataactagctcaaccctgctttctgcagcacttctctctgcaggcacacaaccctgaagatgcacactaagtgggtctaaaaggaaaaaaagaaagaagggagagaaggagaagacaaggagggaaggggagggaagacaaaagggacaaaattgttttttgatttctgtaataggagaaacaaaattaattagggaataaaaagtattttcaaattagcctctaaatagctatgtatattataaagaaaatattaaatttgtcacatagctggattgcatgaatttcctagaagaatctccttaaacaaaaagtggggataaaaataagcagtgtggtttgccttttaaacagtaatccagtacagacatatatgccttcatccatccattcatcaaagaggaatccaatatgaagctcactctcagagagtgtaatgtctatttgggagtttaaatatttaaataaatacatgtaatttaaatgtaaaagagataaatttcttaaaacaagtataattaagaactatggaatttcccaagagaaaaaaaattcttcaactttaagaaaaggagaatcttcctaagggagatatgcattgaagagtctaaatgaattttaaaatataaatattttggaaaaaattatgatgacttaaacattagggttgtctgagagctattttgtagtcactagaaaaacagacgagatgagaaacctgtggagtcttggtcttgtcaaatcaagtaacacacttaaagaccacagctttaatcaaagtacctttaacttaagaaaatgatctctagtactaatgatagtgagctgtgaacatgaggaaggtgctactcaaccacaatatttatctgcatctcccctttcccttcctacttgtgatctataccagttgcctgcatttccttgatactcatatactccttaaccccccaaaatctggtttttctccccaccaatattgtcctgtggcctcaaatgtcactaaggacctctttattgcggtatgttttgattagtctcaacacacattccttcaaactcttccttcacctggattctatgacactaccacaagaattttcaaacatactgttatcaggagaacctttctttcatataagatcttgcctagaacttcaactgattaccatagctttatagtaagatttaaaatcagactgtaagtcctccaattttgttccttttcaagatagttttggctattttagattattgcatttccataattttttaatcagactggaaatttctaccaaaaaaacctattgagatgttctattgaaattgcattgacttaaatgttaatttggaataactgacatattaacattattgagaactccaataatggttctctttatgtttcttctgctttggattcattaagcttcttagatcggtgaatttgtagttttcaccaaatttagaaaatctttgcatatttatttatttagatttattttattttctatcccttctacctctcttttccttctgctactccaatgacacaaatattagactactttatattgacttagagattactatctatccattttttcccttttctttctgttcttcagtttggatagctttgattgttttgtctacaagttcactgatcttgtcttctgcaaggcccaatctaatattatctagtgaaattttcagtacagatattatttctttcaattctataatttttattaatttttgaaatagttttcattttcctgctggaatttcctataacttctcttgttgcatctttgttttcctttaaaacctttaatatgcttataacagttgttttaaagtccgtatctagtacgtttcaacatctctatcatccataggtctgttttagttgattgcatattttgctttttttctcaggttcttgattgtatgctggacattgtggatgccatgttcttgaaggtggagatttttttatcttccttcctttaaagggtgttgagctttgctctagcagacaattaatttactgaaataacagtttaattttgttaagccctgttttcaggatccattcagtgggtctagagtagctttactccagagctagaatattttattcctaaagtgtggcctttctgaggtctcaactcaatgccctggtgttgagtggggtttctccactctaatcagtcagcatttgaaatcttctagtactgtgctgttccaaagtactcccagtaccttagaggctatgttcacttcaagcctcccagtagctatagcctgctagacctcacagaaatatactcactacatgattggttaactatttggcaaaggactcaagggacccctgcagacttctagagttccttttttgcacagctccctcctctctggtatccttccctgcaaattccaccaatattagcagccctaaactctaatctctgattggaaactgagagcacagagaaatggaacccaaaaagagttttttgggtttccctgaactcaatctcagacagaaagccacattccttgactattgagtgtgttgcctctccattccctctgccatttccctgccccagttatctctcacctagctgagatgcttctacctctcgtcggtttaccaatcagttcatccatacctcactgccagattaatgtgactatagctcacctttgatcagtcactgactccttggggattacttgtcacctgctgaatcaaaggaccaaatgcttaactctagatcacaatccaatcctagcccacctttccaaacctacaactcaccattccccttcacacacaccatgctccttgctattcctgtgggttctagccttgctgccttgcgcatgctggttcccccaccagaaatgcctttcctctgcatgctgaatacctaaaccctgtccttcatagcatagcacaaatgccactggcgttaatagagcttagttggctgccccacctgaagatgacctttcccaactccgagcccctactctgtgagaggggaagagcatggcatacacaacacttcccagagtgaaggcagcaggacagatgccagccccaagagaaattctgggaataaagagttccacaggcaaagtttaggtaacagtccacaccacagcactccctagaaatccacattatgtattcacgtattgaaggatcgcaaaagtcctttggtaggaaaacctacgtaacttttttttttaatttgttttggtttaaacttttattgccaaccttgaaaagcaacatattaaccagttatcttgtgataagaggacaacttgccatttttcttagaatctagtaggcagtcctgcggccctaaagcatgtgggagtggctttttgctcacttggctgtacccctcaatgggaggaagcaatggaaagaaacgtttagcttacaaacacatcaggacctcaaattaagttgttgagccacttgatattctttaacaaagtaagtactgatcttatcaatcttcccacactgcctcacgccctcccatctaggtcactaaaaaattatatatatatatatattttagacggagttttgctcttgtcacccaggctggagtgcaatggtgcaatcttagcttactgcaacctccacctcctgggttcaagcaattctcctgcctcagcctcccaagttgctgggattacaggcaccaccacgctgggctgattttttggtttgttttttgttgttgttgttgttgttgtttgtttgtttgtttgttttgagatggagtcttgctctgtcacccaggctggagcacattcgcaaaatcctggcttgctgcaacatccgcctccagggttcaagcaattcccctgtctcagcctcccaagtagctgggactacaggtacccgccaccatgctcggctcatttttgtatttttagtagagatggggtttcaccatgttggccaggcttgtctcgaactcctgacctcaggtgatccacccaccttggcatcccaaagtgctgggattacaggcatgagccaccacacctggctgaaaaatatatttttttaattttttatttccgtaggttttgggggaacagatggcatttggttacatgagtaagttctttagtggtgatttgtgagattttggtgcatccatcaccggagcagtatacactgaacccaatttgtagtattttatccctcacccacctcccaccctttcccctgagtccccaaagtccattgtatcattcttatgcctttgcatcttcatagcttagctcccacttatgagtaagaacatacgatatttggtttaccattcctgagttacttcacttagaataatcgtctccagttccatccaggttgctacaaatgccattaatttgttcctttttatagctgagtagtattccattatatatacataccataatttctttattgactcgtttcctgatgggcatttgggctggtttcatgtttttacaattgcgaattgtgctgctataaacatgcgtgtgcaagtatcttttttgtataataacttctttttctctggctagatacccagtaatgggattgctggatcaaatggtagtctacttttagttctttaaggaatctccacactgttatccatagtgattgtactagtttacattcccaccagcagtgtagaaatgtttccttttctagtgttccaaggttcccacacaaggaattcttgaatttggaacagggacctggattgtagtcctgattaagcacttgttggtgctggtcttccccacgcccagataaccatgcatcataatactggtggcatgtttttcccaggccaaggtagggaaattgtacatcccaacatgggtagggtaaccatgtatcacatatgtatgacaagttgttctgttcccaagcccaggtagggtaatcacacaccccaacaagggtgacatactatcccagcataatcattcattgtgaaccttgcactctcaaaagcatcctggtttgggtgataaattacatagtcacttagttataagccctccacctatagacttcattatatccagttcctaaatcaaaccaaaccaccctaacaagagtagaatctagaattaacaattttcccattatacagaatgttgtttttctggactccaggccactgtgtgccagccatagttatttcctaacttccaccatattgatccagtcgatgcgacaggacgtgtgcctgagactcttgttctattctttagggtcccattggagctaaacgcagccataagttcagactgagtttgccataaatccctgccattgttccctcgtgtgcttctggctacttgatagggccctgctcccaatagactgttcgaaactatgacattatcactaacacttgagtgtaacacatcacatctgaaacctacaatgatggtacccatctcctctttaccccctcaggactggagttccctacacactggcactagacacattcctagttcctaaagattaaatggcttacttcccccacaatgactatagccacatgggttatgaggccagataactaccggtgtgacctttatcaaccacccctcattatgaatctcagttaactcatctctgaaatgaactggccggtctgtatggcatccaacattccacccagctgtgatgaattgactctatgtacccttttttgaaacttaactacttccacataaggcctcacttcccaaatatctcttaaaagtggggtctctttccatatattttttaaatctccttcagaacatggtagagaaccttgaacatggttggaactcaaatgtatgtcacataaggatttttaaatgagtgaggcatttaagcctaaaaaaaatcaaaattagactttgagatgatgggaaattaaataaatctaagaagtgaaatgatctggtcaaagcagcaagcactatagaaaaataaattcatatcattttctagcactatgactagtgaactagcactgccaataatggctaacattggacatttaccatgtgtgagatgcagctctcagtggcgcacaccaaccctatgaagtgggaactattattgaccctactttacagatgagaaaactgaagtacagagggtttaaagaacctgcctaaagtcccccaagaagcaagtgatgtattcaaacccgggcagtctagctccaaagtccatgcacttaaacactaggtcagcctgcctctccctctttcacaagcatttgcacatctaagcatcccaacaacaccaggttattacgcacccagcagaaactgaggcccagagaggcttaaagatcacccagtgtcacacagcagtctcagcgcactacaatacacttttgaaatgtcactgacagctgactgctgagaaacaggcgcagaataaagtggaagtgccactgggggtcagcggctctggagagaattaaaattggtagtaaattgaaaggaagaggtgtttgtgggggacacgatgaagcgagaagtgacagccccaggctatcacctgaagggaaggtcaaggtgagggagaagcctgcagaggccacagagtggacagttgaggacccaggagcatggaaaggtaggcacggaacagtttagtaaggacagaaaaaaaatgttgtttgccatcgcatacattttcagcaccagtacaaaagttatagaagaacacacattttgaagccaggaagctgacttttggattaggacagtttgactgcagcagcattcacaagagaatctggtacggcgagtgccacataataggcactcaataaatgtttgttccaaataaaagagacaaaaagagaaaaatctgagaactgctttcataaagagaaaggcacctaagggagtaggtgctcaataaatattattttttatctttgtgccgtgagaagcctggggagctgtaaaagattatctgatccatttccaaagagccctgagcctctgattgcaattctcgcaaattcccggggaaggctgtggaattcctctctggagacttacaaacatgcttttagaagagccacttggagggagtggtttagacaatttcaaaatgggtgaattgaggcagagaggctagaccgaatgaccctgaggtccttttcgtttctgatgtccacgtaatcccctcagaagctgaagtttccactctgctcccccatggcacagagatgaaccgaatggacctgcagacattgctgtcccgccaagctgaggacggctgagtgatttggaagccttccagtaggatctggttaaatcgtaggccatttattttgtgaagaaataaaccacagagagcccctttcaaacatgcatacagaaatcaggacaaaatgccaagcagattatctgctcagaatttgctttgaaagagcccgggcaacactcatttatttttgagaaaatatatgattaaccagagttaactatgaattcagatattgtgcattagaccagcttctcaaagtttgagcacatttaatattatatatcgctgccatttggactaaattgtttttttaatgtacacaatattacaaatttaatttgagctgtttgaatcagtctgtaaaaaagatttgattatacctgagtgttctggccccagcgtttccgtatctcagtaatcttgacggtaattggctgattgggcgtctcacactccatctctgcctcagtttccatggtaatgttacaggagctattatagatgagaacttcatctctttccaatttagggctgaaacgagaggggaggttaaatggggtgtcatcaatcttaatgaaatgcaattatttttactcttattaatcattgcaagccattagcttgtggcaactacaggccaccatttgtcaaattttgcaaatttctgtaattttgtttccattcttttattgtttatttgtttttccttttatctgcacaccctgcaatgaaaatgcaccatggtaaatatctttcactgaggcctttctcttttccgaatctattaaaaacattagcaaaagctactcctagcccagcttaacaagaaatgcagggacaatacttccagttccaaaaagggtaacaaacgtctgggagagtttttgtttttattttttttcttttccccttccctcttcctgctcttactcatacttagtgttgggggagtaattgcctgaatccccctagggcagatggagaaattggaaaacccacacaactggctaactggtccctaattccaactgtgaaaaaatgagctcatttaggcttgcaattcccccttcccagctgatggcaatgaggctctgttgctagcagtggaacattaacttagtaaattaattaaacttacttaacagcccagactaaggagattcaatatatgtgccagttatactaccagccactcgctttaaaagtcctcttgctttaaggggagaagccagactggatttaaaataaaaaacagcagtgtagcattacagaaagtctaaaaatatgccatctagaggtgaggacatggatagtgaagggtgtcatcctcaacaggtgtgatatttattcaagaatcatcctggctgtaggcatttttgcaactaactcaaaaattatcagtaataataatgcatgatgtttcatatttgtcaacaatttcacatgtatgatctcatttcagcctataaattaggaagaggtgtaaaaagtgtaacccaaagagatcaagagattctcagaaagtcaaacacagaactacggtagctccgaggtcaaaaccagatggtcctgtttcccagagcagtgctctcaagttttgaaatgctgattgaacatcagccaggaagatggcagatcccatgggaagaccaggaagggtggagagaagggcaaaaaggtcaccacttgagaaactgtacaccatgtcaaaccctaccatcttttttcaaatcaatgtcaaaatgttttcttccacaattttctagaaataatgagcaggataactagtacatctcaccacttaatcttcgcttcttcatgctaaaatattctccactctgtatctacctaagacatgacttccaaacccacagtcctttagacctaataatgtagactgtcaatatgttaacatcatgccacccatatctgaacgcagattgtttgggctgaccactgggactccggtctgcctttatctgagcctccttctcacggtacctgatactgtgttcattttgaaggccaccgtgcttatacttagatagtggtcaattcaaagtctcagagctgcagctttctgaggatttcaccatggtgtgtttgttcaaatgattttctgaggagcactggcatgtaaagcttaggctcagaagcagatcagctggatctgaatcccggggcagatggttaccatctacatgacattgaagacattacttcactaagctttggtttccacatttataaaatggagttgccaataatcaagtacctattttgtggaggtgttgaagaaactgagcaaaatgaagcatataaatagattagcatggaacctggcacacaatacgaatccaataaaggcagctcgcgttatagctgttggaggtagtagttttagtagcattattgttaaaaatgtaaatgtggaaatttacatttattattgttacatatctctcactggtttagacctgttgctcaaatttgttttgaatctgtagcctgctatctagctgtaaatccattcgctgatccttcgtccacagggcagacaaagtcacaggataaatccatcctttgctcctggagcatcagtcgtattccaagattcagaaaggaaaagcaaagtaatttaacttttaaattaaaatgcaatgtaatatttagatcaatacagaaatgtgatggaatcaaatgcaaaattcacgcagacttttaaaacacctcacttcagagcaacttgaggcttgcatcaggccactttgggctttgcacctagaacctttttttgttactgggggtggagaagtggttggaatagtttgtgaaggtctcccgctatgtttatatcataagtcacttataaacctatcagaaaggaaatgaagttggtttcccacaccatcacattcttcgtaaatcggtttccagatggctactttcatttctgaaggctcacaaactatctgatgaatagttcattctagaattttgtcagggataacaccaagcttagttgtctaaatttccagaattcctcctcttttttttaggttcatagaatatctgcccatcacctctgttatgtgaccccttctcatggttcattgccagcaataggtcctcaatcataagagtgagttttttgtacccagtttatgaatgatctgagactacagacttgaactcaaggaaagtagtgaccaacttccttctacatcctttcttggccttgggcttccacttgcctcataaaccttcttatgccctttcctgactcttcgctggcagaggtacaagtaaaatgggctgagtcactctaccctctgtttgcctgttaggaacacactgttttcactaagcatgttattcttgctctgaagagaattaaacccctttctgttagcttggactttttgtttaccagcttcagctcacacttttttccatatttgtaactaccttgctagaaatgtttttcattaaaaagccatcaccaaaattagctgagacaccaggatatccaaaataggttaacatttacaaaatttcaaagcttctaaatagctagctactcttccatggtttcttccacaataatcctatgaattaagaagcacagttggccatatttaaatataaatataagcatatatatatgcaacataagcatatatagacagagagatcaatatatgtacagatacagatacagatatacatgcatacacactgcacacacacacacatatttactttgggggatatggtttaaaatattgggtaaaaatggtggcaaagattgttctagtatctaagactcctgactcccaaactattgttctttagttgatctgattagatcctaaagtaagcaagtaaccttggctgtgctccttaggataggtagggaaaacaatttgcaggcattttctctccctcacttcccctgaagttgcttcctgtggctctgaaacctcactgaacccacaaagctcagccagggctctcacactgaagctgccagcacagcattgcactaagcacactgcatcagaagccttgagttccagtctcaacactgccatggcttgactgtgtgactttgggaaattacttaatcttcacttagaagagaatccaaactctttactttggccttcaatgccttacatatctctccgagctcatctggggccacttttcctccttctcagtctactcccaccctcctagcctctgaacagtcataaaactcgacagttcttttgcatttgctgctgccactgcctcaccctccataaagacacctgcttctcttcgtaacataaaagacttcttcagagaagcctcctctgagtacactctctaaagtagcccccctttatttttctatcactttatagcacttatcacaacacgtgatcatcctgtttattatctgactttcttctctacccttaaggggcagggactttcatgacatccacgaatgagccaccagtacctgtcacaacacctagaacagagtagggatgtgatcaatactggatagatggatggatcatggatggatggatggatggatggatggagagatggatggatggatgaatatactggataaacagatggatcatggatggatggatgaatggatgggtggatggatggatgaatacactggataaatggatggatcatggatggatgaatggattgatggatggatggatagatggatggatggatgaatatactggatagatggatggatggatggatggatggatggatggatggatggatggatggatggatggatggatgaatatactggatagatggatggatcatggatggatggatggatggatggatggatggatggacggacgaatagacagggtataatttttgccacagatgcacttctccctttgccaaatgacatcaaaccccatagatgttgtggatggcagggagatacagcattgtgttccctggaaaaacacataaaaactcaatgaagaaaataaatatggtcagtactccaaccacctagagataggcaccatcaacattcttggatacatctttccagccttttctctagtaacctatgtgtgtacaaacatatacactatatacaacagtaggatcaaattgatatactcttttgagacctgtgattttcacttctcaatatattataaatatttccctgtctggttaaatattctacatcctaatttttaaaggtgacttagtatcatatcatttggatacattctttattactaaaacttgtttcattgcaaattttttttgatacctgaaacttcaaagaacatgattgttataaatattacacatttctatctactttcttaaaatcctaaaagagaaattgctgggtcacagagtataaagaatttaaggttattcgtgaatcggcaaattgtcctctgacgattgcattaccttaccttcccactggcaaaaagaccgctgccagtttcccccactctcatccccattaaactttgtttgtttaaatcatagggcacttattataattcttactcaagaaaacatacccacttttggccgagtgcagtggctcacgcctgtaatcccagcactttgggaggctgaggtgggcagatcatgaggtcaggagatcgagaccatcctggctaacacagtgaaaccccatctctactaaaaatacaaaaaattagccgggcgtggtggtgagcacctgtagtcccagctactcaggaagctgaggcaggagaatggcttgaacccgggaggcagagcttgcagtgaaccgagatcttgccactgcactccagcctgggcaacagagcaagactcagtctcaaaaaaaaaagaaaaaagaaaacatacccacttttgcctactgcaatagccagaacattgagcagcactattgaaatgatattcataggtaaagctatactgtcaatgcgttctgaggctcagttgcttcagccatcccatacaatgaagaggaagagcatggaagaaccccaaagaagagttttggggattcagatgaagtccctgaattcaatggagccaggacctactgacatgtacttcctggtgtccagcatcagtaagttctgaaatccagtctcacctgagtacaatacccagcactccatttcctgtgtgagctaaacagagttcttcttgcccttttagaaagcaaccagccaaggaggttcctcttttcctccagctaaacctaaacctctggtgccaaattcacactaaaacacaaactgtctcaggacatcacaaagtcagatgccatgaaaagagctggttatctctttcaccgtggggaagtggtcttgtttagtttcatattttataagaaaagaggcggggcacggtggctcatgcctataatcctagcactttgggagaccaagtcgggtggattgcttgagctcaggagtttgagaccagcttggccaacatgatgaaaccctgtctttactaaaaatacaaaaattagctgggcgtggtggtatatacctgcaatcccagctactggggaggctgaggcatgagagtaccttgaacctgggaggcagaggttgcaatgaaccgagatcatgccattgcactccagccttggcgacagaacaagactctgtctcaaaaaaaaaaaaaaaaaaagaaaagaaaaagaaaagagaccttcattagataatcaaaggtagccactctatctacgtaagacataaagaagtttacatgacaatgttcagtcatgagacactgccctgtataggaaaggaactccttgctgaaatgaaagcaatccagaattactagcatggtcacacttcttttttatttgtttagaaaaggggggttaacttggaaagttgtggtgtttatttgtcagcctcttttttaagttaaaaaaatgcttatacgcttatggcttctaaatcctagatctacagtaattccgcctatgcaaccctccttcttttgaataaacattgtacaatctgctggatttctctatggctttttttcatacttgtgaatctgtttggaaagaaaagaaaaaggaaagcggggaaaaagccttctgtttttcataacgtctaatctttttccccattggcattcaccagatgttgctttggatcggaagataaatattaaaatctaagcaagaacaaagcgagctgtttactgggcagatttttcagatgttctcttaaacagttgaaaaagacaggagatgctttgatatgcaggctggctggaatccacaatggaatggcccctccaagagagttgtagcccttaccacggctgccaggccacatccacccagcctacactctctgatggctccatcggtccattggccaagcatttgtggggaagttcagggagggagaaggtaaagttacctgataaagaggcccgagaatgatggaaacattgactctgcccaatgatctggcacaaagaggcattgggaactttcctcgcaaatgtagaggtaaggccacgattcaagcagttgctctgtcgccatggcaactgtcaaatcacactgcacataggtgtgtctggcagcctcacagctgtcctcctcacgcttcaggccacacaggaaggccaaggacactgcaggaaacagtcaccattaggaaagaaccacagagagaacctaaggcctctagtcggtttcacaaatgaagttcctgtgtcctcctttgaccaataggaatatgaagttagcagtttactttttttaaaatgtattgtatatgtgtaatgtacacagaaaaatacaagtatcatttttgtaaaatatgaataatcatcataaaaaaaactcaagtgaatttcccagccaacataagatataaaacacttataatacacttaaatctgtgtgtttctccccaagttcgtccctttcctcctcattctcagaaataaccacttggcattttttaaatagttttatcacaaacatttgtattcctaaacaagagattgagttttccttgtttttgaactttataaaatatgatacatgataaaatattcttgggtctgattttttcattccatattatattttcaagatttatccacattactacatataactattgttaatacattttcactgctgttcaatattgtattgcatgaaactaccacaataaatttatctattctcttatcaatgaactttttggtatttcctagcttttgctactaaaaacgtacaaaatttcatctagggtgcatgcctatcaagaaaatttcttattcaaagagtaggtacaagttcagctttacaagatagtgccatattgttttccaaagtagttgtgccattttgtattcctaccagccatatttgtaagttcccattactccatataattacaagcacttgaaattatcagacttttaatttttgccaatcaggtgtgtaaaatggcatttcactgtcgtcttaatctgcatttcaatcattacttttaggttgaccaattattattattattattattttttgagacagagtttcgctgtgttgcccaggcttgtggcacaatttcacctcactgcaacttccgcctcccgggttcaagcaattcccctgcctcagcctcctgagtagctgggactacaggtgcacaccaccacaccccggatgatcttttgtattttagcagagagagggtttcaccatgttgcccaggctgatcttgaattcctgagctctggcaatccacctgcctcagcctcaaaaagtgctaggattacaggcatgagccaccgtgcctggccaagttgaccaacttttttatgtttggtaacaactcatgttttctcttctgtgaaattcctgtttctctcatttgcccatttttctattgggttgtttgtcttattgacttggataagtttatgaatttcttgattttcacataattataaacattagcatgttatagagataaaaagcaagtatttgaagcatgctgactctcaggccatttttttctgagtcatgacccacatataaaaagcatcatgaggcagactgggaatgatctttaactagaagatgaacaaagctccacatgagatggtttaggagcagctctgtctgaaaaccttaataaagagggaaaatttaaaaaaatctctgtagcctgcttcctctgcagcaagcctgcccatgtgggtaatgcaacagaggttatcaagggccgtgggcttagacctgtgcttccccgcctcattacagtgctgtggcaagggttacatgagataagtacgtgggggagggtttgtagttatgcaatcatgcccaaatagtactattgttgctgttatattctaaagcacctggcacctaggaggttggctgtgaatgtgttttgaatgaattagagcaataaaaatgactgacagtaggactcttgtatgaacagacaaaacataagaactttccagttagtaagccctaaggcaaataaaaacaagctccacacctataaaataatgaattcattaaaggtgattaagtagatgcaaattgacaagcaggattatgaaaatcacccagggctggggatcaaaatctatgggttttactcaaagttctgccactaaatagctgcgtgaccttaatcactttagctttccatgccttatggaaaagttaaagtttccatgaaaatgtcatgtggtataattcaaggtataaatgcaagaaagccaaagatcaaagattttgctcattttaaacaaacacaaagtattagtttcacctaacaggatgttttggcaactcattacaagaaaaaggaaatttctcctatggttagaagtacagtttgtggggatggtaaaaatgggtgacctccaaaatagcaaaagcacatttgtagagccccctgctttaactccccctgccccacacatgtaaagaaaacatattagttctgtggcacaggcataaacaaaacaataattaagaacgtttgagttcagggtcattatctgtaacctggaatgtgaaacatcactctatggtacaaagtcaaactgaagaaaaaaactcaaagcacgggtcagaattcaaagcgaccttggtaaatgagagaagttaacagaaataaacaaaagaacaaatgaaaagagtaagacagtaaactacaaaagaaaaaaagaaatcatataaatatgaggaaagtccagctgtgcacagccatggtagaaatgcgtgcgtgcacacacacaccccttgggataacagtaggtaacagaaagcttattaaccagcaagactgcagtataattgtacaaacaaacatgggatcagacgatacacaggcatcttacgatgctacccaatttggccagaacttgcttgtatagaacagcttcctcatttggggcttcaaattaggaaagaatataggatttcagagagggctgaaaagtgagatactaaaatgtttacttggaaagtttctgattcagtagggcccaagaattcacatttctaacaagctcccgggtgaggcccttgcagctactgctctgggaagcacacttccagaactgctgccatagaggaactaagaatactccactttccaaagaaccacccgctgattaaggttgaaaaaattagagtaggggagcatccattaggcagaggatggatttctctgaaaagagcaactgcgaaacacttgtaagggttgctgctgggaaattctcccctgaaaaatctttaaaaatacaagtgatttttagctaacttggttgtactcaatcctgtctgaaaatggagaaattagtagtagtttctagtaatgtctaagacctatcccctttgacatttgatgtccattatagacctacttcctagggaaaaaaaaaaaatacacagtcatacactcaaaatgcttcatccagtttcagcgggttaacagaatccccaaatcccatcttggatcttaagtaagaaacctctggagttggctctcacaatttcctctcaatctttagacattgtgattgaaagtcttttaaaagacttttttatgaaaggaaaattagttaaattatgcattcctctagagtaaatgtgtgccttgcacaatcaatgagtgtttggtgacacctagtggccatataaatagttacagtttccaactaattttcctctttaaaaaatcatggaatgttgagttcttttctaaatctttctaaacacaataattattttattattcttccccaagaagttataaaacttaaaatatcacaacttacctgatcctgaaacatcattgatttttatcttatactagttgaaattaagtgttttgaaataataacacggggcttttaaaagtatattaatttgagcagtgtatatatgaaagcttttttaaaaaatgtagcagtattagttaaaaattagagcctataaatgtgcagtcttagctttctgtttatgctatctctcatttattcctcaccaagcactaattttgcacataccctctgcaacactgttcctagcagaggaggtagagcagtgaatcagacaatgttttgaacttcaatcttctattgtatcttaaatttcccattgtggactctatctctcttccataatgtgtttatatacatgatgataataggaaactcaatttctagcattttaacaaaaatttttttctcctccccttcttcttcctcttccctcttccccctcctccttcccctccttctcctctttgtataagacaacacagcacaaatttccatcacaatagcattatccatcattaaattctcatccaagctcagatgatgtggtgcttttatcattttgtaaatctttagcccacattcaagttgcagacaaataaattaggaataaaacttaaacactacacagaaaggaggtatgtaaacggttaagtgcacaggtacaagatttatgattaggcaaataaggtaatcacctggctaaatgtgagctatctcaaatgtagtaaggtcctgtagtaataacagtaatttcttccttttgactttatttcctgaagctcagtggggtattaccatgtgttgtgaatccccaagctttgcaacttactctctcatctctttccccacaaagacacggcttctcataccacaatttatatgatcactacgcagcttaaagtagtgagcaattgtggtgttttactgaataagaaataagtaattatgtgagtattgcaaaacaagaagacaacatgagtgttggctcttttgcctataataagaaaccgaaaactgaacacacaaagctaattttcaagtgatatccagcttgaaaatctccatccctttactggtacctccaataagcagatgtcttcagcaacctcacctcagaacaaagccaagagcttgtttcctccatgactcctatagctgtcattgaaactaatattcagaattcagaattacttcctctgtcatcctaagactgcagttaagaacacaggtgataagtgtttcaatattcatctaacattgacatattaatatgacaaaagttatgatgaatcattttaacaggtggcctcagattctaactatcattttagatgaggagtagagaaattcttttcctaggcacacatagagaaattagtagtcagtacagcattaatcacaaaaatagaattaaccaaagaatatcatttccatatatatgctttaaaatatatgtgtgtggcatctttactcaccatccaggggcagaaccaagcagctgaaggcagacactgtagcattagccaggactcggcagggagcaccacacacagcagctgagacattccctggagaaaatcccgctccaaacacatgcaccagccttccacccaggcagcctttaaagacaaaggtacaagttcttgatcatacaggcaaatctcccttctttactcaactcaaaattcaaacatttgcttcctcactacccattcttcttttcacatcctcagaatccgcacaactggcttgaggtggctgctggcctcagtttcctctccacttaggctctggccttgtctgactccaatcacattcaatatcctattgtgttaaagaggtttttttttaatgtaacaatttttatatggaaaattaatgcttatttatagtttttaaactttttattcaaagagccataaaatgaaaataaaaattcccccaaccatctgactccctccccggaggtacccaggtatagagtttcttatggctccttccagaatttttaagcatctatgtttctgattcaaagcattattctatccatattattctggaacttgcttttttgcttcaaagtatagcatagatgttttttcaaaactctatggatccagttcattttagtagctacttagaattccattatagggccctgctacaatttatttgacaattttcctatttattgaaatttccattttttctcctcttttgctattgttaatagtgatgcaataactgtacatgttttgggacatttgtatgagtaaaaccagtccacatttctagtttacactgagatacagagttcccctcactactgccttcataccaggtctaggtggtacttagccacttgactaactcaaaaataatgcttttggtttaagatgcatttcttatttccctgctcttccatcataaaaaaacatggaatcttagggagtagtgcctttatcaaataaggaagctgagtctcagaaaagtcaagcataaattagcaaaattagtgatagactagagccaaatcctagtccccacagtgttccaccaagctgagaccaaattttttctaagaaatgtcttagttagtactccaacagtctaagattctgtttctatagtttttttccttactttctaaatcacaaccaaatttgaactatctcaagtgcaacaaggctttaagtgaatagaaattgaaagcttttcttcactggagggaaaggctaggcaatttttggtatatctaaacggagaaaacagtccaaccaatttaattgttctgtgcatttggcttattattgttgaaatatgagtccacctgtgaaatattacaaaatgataaaaatttaatcatacttaataaattttaaacaacgcaaattggcagatagggtctaaaactaggtgaaggcatttacgttcttaaatgatcaaattatgagctcttacaaatggtgttatttaatttaaaatacaaatccagttaatgcatcaaattaaaatacaatcaaacatttagagaatatgcacagtttccttgataaaaataaaaaaaatcttcataaacagagcataacaaagacaagcctcaggaaggaattgggattgtaagaagccagtgggcttctctttccttccatcaggcagattgtgttaattttctactttccagaagtgaaaggagctaccaattcatttacataaagaaagtgtgctgtcttatttgcttgacttaccgaagttctccgtcactgctgtaataataactcttgaggtgaacaccagggcagatgaggcccaccctctgatgcagtcatagcctctgacgtggtactccccggccggaagggaagggaccacgcactgaagaacggtgtggttaccagagacacccacacagggtgacattcctataaaaatgtcaatgtttgcagctcctgagatctgggccactgcaaaggttaagatgtcatcgctctgagaaatagagatcaattctggggtaaaggccttgttataaccaatgactcctatgtgataccaaagtccatctacctctatttccagggcaacagagccattccctgtgggaacaatgcaccggatgagctcagcaccgatgttcaccgtcaggcaggtctgctggtcaatatagactgacgtggtgttctgtcctctcaggcctgtgccctctatggtcaagaggcttccaccatgtaagctgaaattcttaggaaaataatgaaacacttggggcataatgtagaagtgtctggaaacattaccagaacaagcatacccatttcttgtataaaaaactgacaggtagtggggtcctggggccaagtctcttgtctggcacacaacgtggcttgcattaaaaaaagttacattgcaaggaagttgatcatccacaaataccatcggctcatcagctgtggtggctaacctctgacccctaatcagcacagtggtcagagacccactggtgtttgtggacaaggcatccatgacaggacttgcctcttcccttatgaaaagagtgcaattcccctgacactcgctggttagcccattgaccaggactgtgacgttcagggagaaggaagctccaggcaaggggtcaccctccaggctaacctggcagagaatggtgtggtctcccaaactcaaaatcacacaagtaaaaggacccgagaggtcaacccgaactgacctccttctagagttaagaagcaaccccctcacagtaagtatggtcccaccacatgccgaaccctgcgatgggaagatggccattatccgaggcatcactgcaaattgctggagcaccacagacatattagcaaatcccatctgcttctgacgtacttggagaggatagatgccagcctccagactgtgaagagggatggagcatccagacaggctcacgttgccctggaaggactgtgtctcaacatcacagttcaggttccccagaaggatgactgagttggagaggttacttcctcccacatgcaggctcaggctgctatttgtgatttctccttgcatggcagtgactactggtgttgctgccgcttcatacatgaaggtgaagcctttccccaccaagcttggtgaaggaccacgggcgaagaacctgttgccagcccagacctccacggcagctggaacagtgggagcgcccgcatcgggtatctggggggctggcagggtttcacaccagatgctcgcctccgttaagttcacaatgtcacaggaccgattgcccacaagtacccaaaccaaagctgggtccctgctgaagcctattcctgagatgctgaggatggtccctcctaaagtatgaatacggaaagcaaaatattatagctgatattctgaactaagaattcatagcacctgtggaagtcctaggtcaattaagtggaaggtagggcatgtgttagtgaaacctcaattattttttctcacccccaccaaagctaaatttgtgattatttagacaggagtcagatgtggtaaattcacataacagtaaaataatacaaattgttatataggaaggacgtcttcaacacaaacttttcaagtacctttgtatatcccagaagccaccactttaatcaacttacacactaatgaaaaatcaaatttcttagtcttcttatcatgtattatattattggaaatattatcctgtatgctatatatagactatttgtacattgtcctgtatacattcaacttatatgctaatgaaaaatcaaattcattgaagtcttctatcatttatattgttctatataatattccaatattccatatattatacattctaatatattctatttattgtaccatatattctatattccatatacgtgagagacattaaaagtcattgaatcttgctggtgaatttgctgctaccttcatagaatctttgccttactctccagtagagaggccaccaaagatcaaaccccatcttcaggacaggattggagcaacatgacccacagcataaccaaactgtacaacgtggcttttaagaggattttactatacccaaaaaggataatgtgctatcttacacatgatcacaactattattgacatgccactagattgttttccattctttctgaaaatagttttagagattggtctatttgtcttgttcttccatctcccatatcagcatgtgtgtttctatttctgagtctttcatctgtctctctcatggaaagtgaagacccgcagattcaatcctcccctccttgcatgcacagcatctaaatggcgaatgcaggacatgttgcccttgtttttctcatatccactctagagtgtcacccatcagacgtttcatcctcttttcattagaaaagcaggcacatctcggctgggcacggtggctcatgcctgtaatcccagcactttaggaggccgaggtgggcagatcacctgaggtaaggagttcaagaccagcctggccaacatggtgaaaccccatctctactaaaaatagaaaaattagccaggcatgatggagggcacctgtaattccagctacttaggagactgaggctggataattacttgaacccgggaggcagacattgcagtgagccaagtcagcaccattgcactccagactgggcaacaagagcgaaactccgtctcaaaaaaaaaaaaaaaaagaagaagaagaagaaggagaagaagaaaaagaaaaaaaaaagaaaagaaaagcaggcacatctccttgtcataaaaattccttaatttcctgagcaaatgaatcaccaagttttaacacccttttaaaaacacccctcagttcctggagcccgaggaaagtttctctcctgtttcccctctctctgacctcactggcaaattaatccagaaacaaaatctgaatatccagcaaatagaattgctggataattgataacagtcacataagagccactcacccagcagggacccacagcaaggctcgatgctgaaaacttctgtgaggtactggatgtggagatcaaccctacagaagataggcagatgtttaggaaataactgacagagagagataagaaagagtaagccagaagagccatatgtattttgaggagaagagcaaactgtctgtaagttctctaagatttgttccaatgttatgatgttcatgtctttaacctctaacttccaagggaaaaagaaaatacctaactcaaaattagaattacctagctgaatgctagaccatcaaacaaatccaaaattaatgcaagtggtcacctcacccttgtgagtgaatgctgaccccattgatagagacggaaattctgtggagaccagctggcagtgggggcagtgccacctccaggccccaagccgactgtgtgtgaaccggagccaaggcatcctggacgtggacttccacatccaaatccgtatagttcatcagcctcgccactccaatgaccagggtctcaccgcctgtgttgagaagaatccaatagcctctgacatgtggggtttgtgggctcaaccatctattcaattctaaaactgtctttttggattaaattcacagtcacccctatgcataatactcttaagagttacgataccaacctaaatttttcaagaaacttctaacaactatttttttttttttttgagacaggtctcattctgtcacccaggagtgctgtggtgcaatcttgtctcactgcagcctcaacctccagggctcaagcaatcctcccaactcagcctcccaagcagctgggattacaggcatgtgccaccacacccagctaatttttgtattttttgcagagacagggttttgacatgttgcccaagctggtctcaacctcttgggctcaaccaatctgcctgccttggcctcccacagggctgggattacaggggtaagccaccttgcctggcttaacaactcttttaacagagatatggtctgtaacctcaatagtataaaaagaaaaattggcaggacaattgtattcaagagacactaacttatttccatgcaaaggcaaatcaagaagtttgcagagctaacggtctttataaccagcaaagagcaccacatattggttgcttaacctccacttttctactggtagaagtctgaagctatatttgagtgtgcactgaaccttacagtaatgctgtatgtgagtttagtagctcataactgacagagtactttcacgtatgttatcccacttggtccacacactatcctgatgatttatatggggcaattaatatgactggtattttgcatttgaggaaactaagctcagcagccacagcctcatagctattaataattactaaaaaagaaaaaaaaaggtcaagacctgagcccagtcttttgtcttgcatttcagtgtccttttagtttaattagcaactctattaaaatgtgtacactatgaacactttcatgcaatttcttttaactcaaatatttattgagtaccataaggaagatgctgcaaggggcacaaaataagttaaacacagactctgccctcaaagaagcctcaacggtagtaaaataggtgacaaaattgcttcaataaaagatatactacaagagaggtggaaattaagcactgggattgctcaaatcagagcaacattatgaatatcaggaaagatggaatgggcaagatgagagttgaattggagcttgaaagataaatccaaaaagaaagtcatagagaaaagggggcttatcatttatttctagaaatttcacggttttatccaaagcctttcatagcaatttctcacttaatcacccagtggcttggagaggaaaaagagaattgggtgatgttctggaaggcacaggtagggttctgttttggggataagccaagttgatggtagtcctagggccaaagaccaagaaagccaagccagagggatgtctgcttaactcagtggacggcagtgaccgccaaagacttgtaagcaaggaaaagatatgattaaaactgttcttccagtctttaagataaattgaaaagataggggaggagaaatccaatctgcagacaattgtagtcttaatcaagtagaccaaatcaagtgggcaacagcaggagtggaaataaatgtccttacctttcctgtgtcccagtgtggccactgaaacatggcttgggctaaagcatctctagctcctttagcctgtaacatttgaggactactgcagagctggtatctatgggatgccacggccaattagatgaagaggaaaaagaggttgcttgaaagagaaaagtcaaagaagagggatgtggtgtggtgggaagactatgaatctgcattcaaatccttgatctgccattttactacctctgtgactttgggtgatttacttacggctctcaaagccttggatttttcatcaataacatggttaataaagcccatcccatgtggtttgttagatatcctgggaaagtatctggcatgatatagcacacaaaaaggccttaattaacttcattttcttcctcgttccccattctcttgaccgcatgtcttcccaatctctactgggaagtctgaagcttcagtgtagtgagttcaagggatttcagggctgatcaaagaaaaagacatgactacgaggtgacagtagcaaaaaacaagcattatttgggtggtattttgacagattcacagaggaggaggaagtctcccagcatgagaccttccagaggcaacagtattgggccaccatccagaaagggaagaaggcaagggaactgggagggggtgggaagatgagagaggggggttctgtgtccagatgatgtcactcagcagcctggtgggtagcctctgggacagagagctccaaaggcatcagcggcttagggtattttatagccccagggttttcttacctacagctgactgatgggtgcagtttcatggggcatgcaaagcaagaggaatttaaatggctaaaaatatgcttattttggctacgctgaaaacaagtggatgtgtaaaagtttgaatttagcactggcaggcttttgagctaatggatcctggggtgccatgaagaagtaaaaaaaaaataggaccaataggcagggcctttctttggcttgtttataaagcattcaatatctggcagaatgatggcattcacttcaacaaagatttattggtgcttactctatgtcaattcctggaccaggtactttcatctgctttatttcctattttcatgattaccttgaaagaattattcccacctatcaaatgaaggaactgaagataaaagaagttaaatatcttacccaaggagtatggtaagttcaactaagtttggcctaaggctgtctctgtaccttgagtctctacataaagaactgcaacccaactttgtgataaactgaaagcctcaactacctgagcctcagttaatcacaggctgccaactgatcagaccatgctccaataaggcaaacagggagctgtttctggcctcacttccattttctgtctataaatgctgcctgcccatgtggcatagtggagctctctgaaccttttctggttctacaagttactatgattctttgttcaaacaaactctgttaaatttaatttcttgaaagttcttctttttaacaagtggttgagctgggattcatgcagattccatttttcctgactgcagaaaccaacactaatggtcctgcacatcaaattcaccagcactccccatccttggtccctcttatgcttttattttcatttcatctcagcctcacggtcatcatcaacatcatctcttggatggagatgtgcagcactccaacttaaaagaggcattcccaaaaggctacgacacttcgtggattttataacatgctcctttttattctgcttgtagaaagatttaaatacaagtataaattttgaaaagaatgcattgcattgtatgtatcaacaacataacttttggagcacttggtcaactgtcaagctaatcctagatgcttccttggcactgatataatgtatttattcttttcattacagataagaaattttattaaaagccaaaatcactgaaatctgaatataacatggagctccccctcccttttctacctcatcaggaagaatctgtaccactaaggaattttacacacttcagtcacctggggcagcaaattcttcttctgcattatctgagctgaataatattggaagctaaaggacacttctctttatttatgtactcttgagctatggaaaatgaaaatagtgccagaaaaattgagttcagactttttctttgggaaatatgatggtctttttacaataaacccttagatatggctaccacaaaccctgttatctggcattcagttcaccagaaagggaagttacctgctactcttccaaatctatatggaattacatgataataaattattataattctaccttgccatatcctctgaatcatcaaagaaaaattctttcatgtagttggtgctaatgaatccattatttttatacgtagaatgtctcaagaaacaagaattctaagttaatcagagcatcctattctctaatcatattaaataactgctacaatagaacctgctgtcaaaaagcagtattttacagttaactacaagtagataagtacttggtatatacaaacagatgacctgtgttcaaatcttagataaattacttattctctccattccttaatttcctgatctgtaaattgaagctaataatcctataaattaggggcaaggattaaattacatctattttatgtttatgctatcattattgacacttactaaatgctcaaggaacatattttgaattgtaacttttgaattcccacatccttttcatgatggaaatggtcccatctgtacaatggttccattttacagatggaaaagtagatatcaggagattgattcgatgatggctaagatgaaaaaagcaatctcctagctttcaagaaaaaacttaaatccaaaatacaataaatttcagaggacattgattgccctttttataggaccaatgctctaagaagaaaaagatcttgcagtatcacatattttacctgctatattgcttatgtttctgctcagagtcacaataactggatttaaggaagagacatatgtaaatgctctgggaagaactgcagaatagtcccctctgatcacagtcacattcacaatgcgtccatctttcccctgaaaaatcaattttaaaaattaaacctcagttttattttaaagtaggactgacttaagggaagagaactccatatagaattagttttaaaagttaattttaagaaagttgttcctaaagggtatatttcctacttccaagtctctctcttctctacaaccctgcacactctccccatcctgcccccacacccacaacacagagtgataagtgcttggactagtaggcaagtgcagtgttagatgcataatgacatgctgtaaggggtaaataagaattatttgcaattaacacaccaattgtttctgcaaaaatatggcaatttcaaataaatgtctatacctagctaaactatccatcaagtatgagagtactttcagacatgtgagaactcagaaaatttctctatgacacactctttcataggatgtacttatggttattatctcataaaataaataataatttaaatatatatatatatctgaaacccaagaaacagtgactactcaagaaagcaatcaaagtaagtactaggataaaatctgtagaataaacctagaaaataagcaggctagattgaaacaggagaacagagatagcttcaaggaaaatgaatgactgatacgatggaactttttttaaaagatattggatttaacttataagaaagacatgttagccaggcacagtggctcacacctgtaatcccagcattttgggaggccgaggcgggtggatcacctgagatcaggaatttgagaccaacctgaccaacatggagaaaccccacctctactaaaatacaaaaaattagctgggcatggtggtgcatgcctgtaattcaagctactcaggaagctgaggcaggagaatcacttgaacccgggaggtggaggttgcagtgagccgtgattgtaccactccagcctgggcaacaaaagcgaaactctgtctcaaacaaacgaacaaacaaaagacatgtttagaaaataaaataggaactctaggggaaaaaaaaaaaaaagaactataaaagaaaaaaatatactacccggttctgccagcatcatctaaatagttagaataatataaacaggttttattaatttaagataaaaatggtattgtaactatatttgaaagaattaaaagttgtttcaggaagggggacttgaagaagggggaggaggggcaggaaaacataatttactattttccttttaacctatgcatctatcacttggatcaaaagtaaaatttattttttattaatgtttatgttctctggtaaaagaaattaagaggtacatgtcttacccattaaaatggcaaatatatattaaaataataaagtgataacccagtattggccaaagtgtcaaaaatcacacacgtgcacaatgatggtgggagtataatttgaaagggaatttcagacaactggatactacatatcaaaagctttagaatttatattaatttatcctgagaaaagaaatgtacccccaaaacatagttattaggatgattaaagccctgttgtttacaataagaaacatttagaaattatctaagtgtctggtaataaggaatagttaaacaaattagagtacaaccacatattggaattgaatgtagtgtacatataaaagctagcttttcataatatttaaggaactagatgagattaaaatgtaggactagtgatcaaagaatattttgaaacttatctcccaggggatctttattttggggtcatgggtgtgctaggaatgttgatgctgcttaagtcaactctaaatagaaagttcagtggcagcagtgcgtgtgactctccccaacagtaccagggaaggacccagactcaaatcccttaataggccatgatatagcactaattgaaaggaaaggaagaggtcagggacttgtttttaaggggaaaaggaagcaatggagaataactaagaagatatttcttagaaatcacacactctagaagtttctaagttctacaattaatacccatactagaaaacaaaattgctgatgaaaactaagttatttgttgtttgcttaatagagaagggagactttgaaatatataagccttgcaagccaacacccagaatgtgcactagctaaatttatttgttacgtgtcactaatacttactgacagtacagaccagaactgcctggttgtcttctttttaagaaattaattgatgttaattacaagctccattggtggggtcagtttcccacttcatagcaaaacagacaatataactactacaagcatactatcataatgagaagtttacatcagttcatttagttctaagaagtgattcactgaaaatgttatattaacagtggtcactcacccagagagaaagagatatgaaaggaatccacttaccctgggtggaactttgcactgaattctgcttgaattgcttgtagcgacattgatggcacacgagtaagatccaaataatatcaggctaacaccttccaaactagagcctcggatggtggcccagagccctcctgtaacaaaaacagcatattcaaatgggatcaccaaccatacaggcagacaaaaattaattatgcacaagatggataaaatgaaattaaaatatgaaactccttagtcaaaacaaaggcaatgctcaaactgcaggaaaaaaactggagttaaatatataaactatcatatagaaagggagaagtagtgacaggagggcagagagaggtagcactgcatcctgaagtcttttaagaataaaacctaggaacacaatcgtgccacaagtctgaagaggtagtctctgaaaactcttcctggcctagattttgaatatcattcctgcaatcctataaaacatattcttttcctaagaaaccaagtgcaacagagcatcatggtggaaggaacagtggctgagagtcagggtcagggccacagattgctcagctacttttagcaggtcattgcagtatggtccctgagctgaagggtcaacattttcctcatctttaaataataatgttagcccttccagctttgtggtttgacactacacatactaggttcagttcactgtgaaaatatagaaatgagtggcatcactgcccatcgccatcagaatttctctactgatcactaaagagcaaccacagaaatccccatttcttccctgcagatgttagcaagaagagagttggctccagttctgctatcatggcacacgtttccatgtggaggagcagcctttgatctagctaatgtataatgattctggtctgccatctcccagatacaagagaggcagtgaggccaccaaacagccttacccccccttgagggtggggagggatgcagaagcaagactactttcaagcatgttggggacagaaaggggaatctacaaaatctgatgaaaacctttgaggacagtgtgactcggtggactagtaccctgaagttaagtgcataactaagagcaatatacaatcgtgatataaaatatacaatatctggaagcaaacttcaaaacaaaaattaagaagataaaaaaattgaaaaaatatttgaaatactcttgaagaacttaatggatggattaaaacttacataagaaaactaaaataaatggatcgaaagagtgaacaccataaaggtgacatatctttataaattaaagcataaatgcaatttcaatagacatataaacagaatttgtacttaaattagacaagctgattcttaagtttaatgaaaaataaacaagaatagccagaaaacaaaatttcaaaaagaagtgtaaagaggtcttctgccatatcttatacagtaactatggtatcaactatgtggtaaaataaaatatagtccagaagaaatgcagatcagtatgaggctatagattaggatataagtgacatttcacataagtgcaaaataaattattcagtaaataaaataagtaaatatcactgaaaaaaaactaaatttgaatttctaccttatatgcttcaccaaaataaattcccaatttatcaaatatttaaatattaaaaagaaagttttttgactagaaggaaacatggcagaatttttattttcatataatttcagagttgcaaagtctatcctaagtattttagaagtcctgaagccataaaaggaagatatattttattatgtaaaaattaaaaatatttacgaatttccaaaataaaaaacaaagagacaaatgataataaagggcaaatatccttaatacataaaatgctctttaaaatcagtaagaaagaacaataaccccattagaaaaaatgggctaaggagataaacagacatttcactgaaaaggaaacacaatgcccctaaacacatgaaaagatattcaatttctctctcaataaaataaacacaaattaaaaccacaatgaaatattcttcttctcctataaaataggtaagtgtcaaaagggttgggaacacaccgtgttagtaaaatgtggtaaataaacactcatatatgcattgttgcttaggcaataaattatgcaacctctaaagagaatcttttgatatttatcaaaatttttaatgcaaataacctcttgacccagcaattcaacttctaggaaattatgctactaatatttttgcacatgtacaaaatgggacaactccatatacaaaataacaaagttggaccctgtttagggctgaattatgtctcccacatccccaccaaaatttaggttattaccctagatcccaataactccaaatgtgaccttattcagaaatgggatcttagcagatgtaattaaactaagatgaggtcacactaaaaaaaagataagccctaatccaatatgactggtgtctttataaaaaggggaatttgggccaggcgcagtggctcacgcctgtaatctcaacactttgggaggccgaggcaggcagatcacaaggtcaggagttcgagaccagcctggccagcatggtgaaaccctgtctctactaaaattacaaaaaattagctgggcatggtggcttgtacctgtagtcccagctactcaggaggcaggagaattgcttgaatctggcaggcaaaggttgcagtgagctgagatcgcaccactgcactccagcctgggcaacagaatgagactcggtctcaaaaaaaaaaaaaaaagttggcaggggtgtgcaagggggaaatttggacacaagcaagacacagggaggataccatatgaaggtgaaggcagagattggggtggtgttctaccagccaaggaacaccaaagattgcctataagacaccagatgttaagagacagacatggaacagagtcttcctcaaagtttggttcagaaggaaccaacactcctgacaccttcatctcagacttctggcccccagaattatgggacaataaatttttgttgtttaaaacactcagtttgtggtacctgattgcagcagccctaacaaactaatacagacccctacctcataccatgtacaaaaattaactcagaatgaatcaggtacctacatctaagagccaaaactataaaaccctcagaggaaaacataggcataaatctttgtaacattggattaggcaatagtttcttagatgtgacaccaaaagcacaagcaataacaataaatataaactggacttcaacaaaattaaaaatttgtgtgcttcaaataacactatttttaaaaagtgaaaaggcaactcacacaatgggagaaaatatttgcaaattatttatctgataagtgattagtacccaaaatactttaagaacttacacctcaacaataaaatgacaaataactcaatttaaaaattggcaagatttgaataagcatttctacaaagatgtataaatggccaataagcacatgaaaagatattcaacatttttagtcattaggaaaatcaaaatcacaatgaggtatcatctcatgcccattaagatggctactgtgaaaaataataataacaagcactggtgagggtgtggagatattgtgatatggtttggctctgcgtcctcacccaaatatatcaaattgtaattcccaatgttggggaaggatcctggtgggagatgattgcatcatgggggcagatttcccccttgctgttcttgtgatagtgagtgaattctcagaaaacctggttgtttaaaagtgcatagcgtacccctctttgctctctctctcctgtcactatgtgaagatgtgcttgcttccccttcaccttctgccatgactgtaagtttcctgaggaatccccagtcaagcctcctgtatagcctgctgaactgtgagtcaattacacctcttttctttataaactttccggtctcaggtagttctttatagcagtgtaagaatggactaacacacattggaaccctcttatattgctagtaggaatgtaaaattatgcagccattttggaaacagtttggcaatccttcaagaagttaaacatggagttaccatatgacccagcaattccatttttaggtatatacccaaaagaactgaaagcatatattcctgcaaatcattgtacacaaatattcatagcagccttattcataataatcaaaaagtggaaacaatccaaatgcacatgatgagatggatggaaaacaaaatatggtatatccataccatgtaatattgtttagtcataaaattgaataaagtactgatacatgttacaacatacatgaaccttaaaaatatcatgccaagtagagaagccagatgtaaaaggtcacatgttgcattattttatttatattagatgtctaaaataggcaaattcacttagacagaaaatatatctgtggttaccagggattgggaagagggagaaacagtgactgactactaatgtatacaggttcctttccatgatgatgaaaatgttgttgaatcaggtggtgatgaggtatacaactttgtgaatatactgaagactgctaagtttatactttttaaaaatgagttttatgatatgggaattatatctcaattttttaagttaaaaaagagatccttggggtaaagaaaagaataaaatatcctacctatttctaaggtatactaccctaggccaagccaacattatctctcccctggatgtctgtcatatcctcctaaccggtcttgctggttccatctttgcctccctactgtgagttctcacacagcagcctaagtcagatcatgtcacttcacttgaaatcctccaatggccaccatctcactcagaataaaagctgagtgagctgagggccattcatatcccccaaggccatataacttgctttgggtcatcttctactgctctcccctcactcaatctactccagccatggcaacctccatgacattctggaacaagccagtctaactttgactcaagactttttgttccttgatgttccttctgacttgaactgtcttccccaagatttccccagaattcattccttcacttcacccatatctcccttctctaaggccactcatgtcattcctccaatgccaatgactataccatcacaaccatctactccatccctcttcatccccttcccttcttgatttttatcctatacacttaccatcactgccccaagaacagaggatttgtttttatttactgtatccccagcattaataatgcctggtaataaaagctaaataaattgtcattatgattattgttgatggtaacaattaaaggttgaagaggtgatgatatcttgccattctcatttgaaagtttagactatggccacacaagagtccgtaccttaaagaagacaatgctatctcagcacaaaaatgaatgaagaaagtatgtaaagcaaagccaagattttcctcaaaaaaatcctttcaagggttttgcttctgcaaatgggtaggtggtgatttatcacattattgtatccattcattacatatgcaaatattctgtaaatttcttgctgataggccccagcctggttctctttaaataccccagagcatcatttctcaaactgtactcttcatagagattgcctgaggacatgttaaaatgcagattaattcagaaggtctggggtggagcctgagactctgcatctctaacaagctcatgggtattacagatactgcttgtccaggaccacactttaaggaccaaggtcttcagcacctcacacagggctaaatgggatgggccaatcagtgttgagtgagtgagtactgattaactcataggtggcagggcaaaggaagaattaatagaaaaagtttaaatccagtaataaggaaagcagcagctagagcctctctctctccctctccctttccccatagtcttaataaaagataatttctacccgcttggcatatcccttctcagagttttccatcttttgctaaaataatgtacaatcctcctagaaatcccttcactgaacagcatgttctgatagggtaaccaactcactccaattttcctaggaccaagttttagcactaagagttctgcattccagttttaaaactgagtcttgtgtcctgggaaccccctcagtcccaagcaaactgggaaagttggccaacctacctgtgcaaagcactttgtctaggggaaacaaaaatgactgagtcacctgtttgccttaaggtggagggagctgaagaaggtatgtgtggcctgaacagcaaaggtaactttgaaagaagatcaaagccccttataactctatagagaaaactacactatgccctacactcaaaccaataattactgggttaatacagaatatgatctttcactctgagctccatatatcatctgaccttccttaaatcatggagaaataagtgcaagttatgcttgctttgttttatgtgcagaaacaaggtggggtgggcctcataattcactcttctaggcaaaatagggtcagaaaaaaatctgttcttttgaacaatgagtttgtggccaaaccacactgcttttaaatatgttctaagctgcagtcctctggactccagaataaaccatgacaaaaatccaaagcattaaggaaaagggctttatgctctaatgtttattcgttaacaaacataagcatcagtattcctgagattcttgcaatctggctgggttgtttttaactggctgtgtccctcagaaagcagaaagtcatggagaaatatttgattttccatagaactaacccaattcataaggctatgttgacaagacccaccaccctctgtattgcccactactcaaatggcaatcagttttccatgctagccaagtatcccagtgtgcatcagttcacaaacttatgaaatatcaaacatgtatgaaagttatgtaggacccaattatgcctgacaccaccagccaaactataatcctttatgtggcaagtgagttcatttaagggctcaaatgtttgttgctcatttaaatacttatgtcagtaaacaaaagacagtgagtcacagtgaatatggaattcattacacagaaggactagattcctatcagcaagaacactagcttcagagggtcagacatactgtgagaccctccccagattaccaatatccgcagctctggaaggctccaccatatccagtctaggtttcacatttaggaagaggtcttctccagtggcactgatggcaagaccagagggtctcaccaacatcaagatccgatgcattccaacaggtagcaaatctgtctgacagactacattggtctggtttgagaaaataactttgcaactcgttttgttcactgtaacctgcaagaactgggagtcaccagagaaaccagttccggtaatgtaaatcattaggttgatgtcaccatcttaaaggagaaaagaaattaaaaaacaaataaaataatctctcagtgatattacttcatttgagagacctctcactatcatcaaatgttccttctctgcccccatcccctcccaaaattcaaggagctgaatgctgaattaaatattggccatctgtatttgttattgtagtacacagccccgatcttaaattttctctaactagtgagaagtgatcactgctcaattttttaaaagaacataatatttcaaaataaaggacaaagacaataaaacatttttagtcatcaaaagtccatctctccccatttcaaatcatgaccatatcccttagatggaccaaaaaatacactttctgctacgtcactcaacctctgcctaatgaactaatttatcttctacccacccatcaccagctacatggcctctaacaaaatcactgcaagtctccggcttaagcccatctcagagccaagtgacaaatcataccaatggagtaccacacagaatggacacagggagttgacccttggaggtactggaaagagcaggaacctgggcaatgagctggtacatcattcactcgcacaaccacctgaaatgaggcaaaatttcttttccattttatgcatttcatatctaccagggtattcataaagtatatgtgaagtgctcccaagctgacacgtgttcatgattcgctaattcttattccttttttctatttttccagtaattaatcttaaattgcaatgaatggctcaaaacacatgaagctttcttaaaatgatggtggacatgctgaaccccatttctgtaattaaatgtgataaatattgagtaaatttatctctgtcatatagaagtaaacttcataaacttaaactgcataaggacttcttatcactctgtatttccaaccaggtacctactttatgtgacaagctctttatttgctagtaaagaccaacaaatttggtgcattccttccaccactctgtgaatatataactaaagactagagtgtatttggacactttacttggggtctcttttgtcacagaatggtagattcctaaagagagactatatatctttccctttcactggaactaatgttaatctaatagaactcaaaaactacttggaaatgagaaaggtaaaaaagatgtgaccccactgattctctatgtataaaaaatgcattaatagcatacagattatattcatgacagtgtttccttattaaaggaagaggtattgcaatggcatggacaataaagaacacttcaattttatctgtactgtttcattttttccataaagacaaaaaatataaatatatcagaatgttgacaatgtcaattttcagtttgggtccccaggtgttgataatattattctttattgtttttgtattttaaaactttatcaaattgaaagtagatgacctataacagaaatatggaaagataggaaaaaaataaaaggactttttaaagacaaaaagaatgacttagctcatttactttttgataccaccaggtagaagcataaatcatatttagctatagaaattatcaattttttgtaccataacaacagtatcaataattataatagaatattgtggttacaaggcatttatattttcagggaactgtacataccctgtggaggtagaaaaaggacagccataagtacccctgttttacacattggcaaaatgacccttaagagctaaatcaatgagtccatgttacaaatcagtgaggagtgagttagacttgaaactggagcttgcacttagggtggcccattcactctcacctgagtatgctggttggcagtagccaacatgtctccaaatatgggtccaagaaaaactccaccatcatataccacacgcgtggctgcagcaggattcactccagtaaggttttcatcagagacctgagatggttacatttctggtaaattctgtcatggaaccgaaatctaatctcgtctaatcaaataataaagagttttttcacattgtgtttcagataatcagacagctagaaagtgaaagcagagtaacagagaattgaaatatagaaacgtaacagtaaataatggctgaggaaagtcccagtagattagagaaatattcatttgcaagtggattgccaaaagaggtacaataaatcaatcttctctctaagtcttgagacactttgcttctccatgcttttccattttatatgtttgcaatccaaaatattaaaataaagtggaaagaaacagtgccatgagataagagcaaggtctcccattcttcctccatctcctttctagaatttcgattgaaaaccagataacccacaacaccatacaactaggaaaaattttcatcttgggcttcattttataataaccaaatgctagttgatcattagattattttttaagaccctaaatatgcaagagcatctggttttgtcattacccaaagacagcaaattcttttctaaaattccttctgctatgccatctgcttccacaatcatctaagtcaatcacatctgcttaaattatccaataacagatgtagaattattgcatggtggacactgaccaataacttcactacctacactgagttaggaagggagatgttgggtttaaattgctttttcagggatatgatatacaaaatatgtgttgaaaacttccagaaagaaagttcatagaatccctttactcaaatattccaacaaaattaataattcatgacagtttccatttgtataattctgatttttttttttgcagaatttctccagggcagcaaatccatgccactagaagggatactatacataccctgataaaattgggcaaatccccaatctgagtggaccaggacaaggtccacacgtgttcgtagcaagtgtatagatcctccttcacagtgaagtcactggcattgaggtacctggatgtgaagtcatcggcattattctgtaagagctggtgaaggtgatgagcagaaatttgtacagggacatctgtgagagaaggttttgatacagaaaacacagacactaattaatccaccttacagagtttcatcctcaaggataacacgatacatactaggatgcctatcaaattttcaggagacccttctgtcaaagtagaacttcagtagaatccccagccataattaaaccattttttcctaaggtaaagacaagtagatgcccactttttatattacactatctttcactcataccatatcacacagcaatcagagagcacagccatgtcagataaaaccatctcaactgtcaactcaaaatgtaaactccacacacccttgtaatgcctgaaagcataattaaatattagatcttccctggaaaaatttagctggccctgtgaacagagaaaaattggccacttttcacagggagtgagggaggcgtacagcagctgacacccataaaaacttggccagcccagctgaggaatgttggcatttaacttcagtttctctattagaattttctttaagcccaaccacctgcttccccattccatgtccccacagaagaataacagctctctgtatttgaaccctgctttgtgctctaccagaagttcccatttcattagctgctcccagcagccctgtgaggtgggtcattgggtatcctaatgtctactttagggatgaagaaaatgaaacccaaccatatgcagaagcttgccaatgcagaaagacaggtttacatgaaaacacaggttgccttctacctactcaagagcatttctcttgaattccacgctgccctgaagggctaataaaatatcactgcgtttctaaattgcaaacgaaattgttatccttttacaaatcatgtttctacatttatacagagtttcagatccatcatcattcaaaaggccaggccaaggctgactttcccagttgttttgcaggcggtgatctgaggatcatcagtgatagaaatcagtagcaggaagtctctacggatgagctgtcttccatgagaagtaaaatcaaatataaatagcacagtaatgagcctcatagaggcagggcacgattgatgttttttcccccatttaccagaatcaacacctagggatcttcgacttctcctgagtcaccctattataataaaaataccactctgttcctctcacccaagaaggtcctgtgcaggcctagggactttctgcttgggagggcaaaagacttttggaccatgttccaacttttatacagcccctctcaagttctactgagccttgcttctgattccccatgtttctaccaaataagtaacgtatcattatcacttctaatctttgttctttgtgcattgtatgtattcttgaagatttacaaacactactctaattgcatctgaaagttctttctacatttgttgggaccactgaaatcctccatagtacatggtgtcaccattaagtctaactctgacggaccatggctaccatgtatcttggtctataaaactctagaaagaagaggactgacccaggaatcaaatacctgggttcacaactggaccctgtcatcagctatttgtatgaccttttggcaagcttcagtgtagttggctgaacggtgaaccccctaaaagatggcctaatggcctaatccccagaaaatatgaatgttaacttataaagcaaaataataaactgcatatggcaaaagatgtggctaagggtcttgagaggaaaaatctgtcctagattatcccaggtggaccctaaatacaattatataataggtacccttataagagagaggcagagaaaattttgagatagaagaggaagaagcaacgtgaccacagaggcggtggttggagtgatatggccacagccaagacatgctagccaccaccagaagccagaagaggcaggagcaaatacttcacaggagtgtggccctgccgacaacttgattttggacttctggccccagaactgggggagaatcattttttgctgtttgaagccaccaagtttgtggttaactccttacaacagtcccaggaagctgatccactcagtttccacaactatacatcttccgcatctacaaaatgtaaaggttggggtagcattaacaataagtccctttccaaatctttcactttaagaatgtcactttcagacactggaaaataaataaaatagctttaatattatcacctgtctgacaacctcccaggatgttgttcccttgggaatgtgagtgagaatatgtgagtgagaattgttgcaaccccaatcacccctttaccagaaatcactgtattaggaagctggatgcgaaagtgtcctcctagaggtggacttgtccgctgtcgtctctgtgtcgtcaccaggaccagtccagatccctcttctgttccttcagtgggcacagagctgtggcacgtcagaaacaaagtattaacgtctgggttggggtgtgcacctaggaggaccttgtctgaaggatgtcctgtcttgcttaggctgcagccttccagaaagagctaagggacctgaggaaactcagtaagggagttttcaggaccactcgatgtgagaatcatttcagagtaacttaattcgtgtctatcatttcagagctaaaaacgttggcatttagagcctaccgatatggtgggcttcctctctgccactgaagatgtctcacctcttcattttcaatggatggttttattgcttttcctgcccagaggaccatggaacaaacatttagtcaaggaaagtaaagcacgggttcaaactttctgcacctgcctttaatatgccattgcagcatgctgtaggtacgagaactcattttggaacatatgagaaaaagatgagagaaagaaacctatacagttatgcatcacttaacagtgaggatacattttaagaaatgcatccttagacagtctcatcattgtgcaaccatcatgcagtttacttacacaaacctagatggtacagcctaccacacacctaggctatatggtatagcctgttgctcctaggctacaagcctgctgctgtactgaatactgtaggcaattgtaacacaatgctacatatttgtgtatccaaacatatctaaacatacaaaagctacagtaaaaatatggtagtataatcttataggaccaccatcatatatttggtccatcaccgacagatacattgttatgtggtgcatgactgtatatttagacatatatgtgtatacacatatatacactgtgaatatatatatccctacacccacatatacatatacatacatcaaaggcagagcactcaattcttcccattctactggggtttaggtgaaaaattaaaagaacaaattagagtatacatgtgttccagaagcttagaagaagcctgatccttagttactgctttgtaaactgtggctagaaatggttattatgaagcaatgcttatggggctttagtgccatctggtggtgagttcttagaaatagctatttttcttctctagacatttcatttcaaaggatttcaacaagattaacacatgaggaatgcaatgaaaagaacaacaacaaaacaaaacagtggtgatgtgaacctctgaacagcacaaaatgccactatttttaaactaactgactcggaattagttctcaaagcgtagtccccagaccagcagaatcagcatcaccaaggaacttattaaaaatgcaaattgtcaggtttttccccaaacctactgccttagaaactctgacagtaggcccagtaattttaacaatacttccaggtgaatctggtgctgcattctcaagattgagaacattgctttaagcaacaagacaggtagcttttcctgaaaaaagtcacacctgtgtccctcaaggccaacaagcattcttaggagaagggacaggtgtaaaaaagccactccttaccgtgcagtgatgagcgggagctccgtgccacaccccgccagccaggaggtgacactgtagaccggaggggatcccaccacagagactgattccaccagattgccccctgggcgagccgttccagaatcagcttgagaaactagagaccagtgatccaattactatcaagtgacttaagatggtagacttgctgtgtggaaaatcccagttggaaatgtgagttactcagatctcagtacacacctaaagcatagattcctacttatctgctgccataaagaacacatggagaggacgcaggaggataagccattcagtttagtacaaaaaggaaagtgcaaggtcctgatttaaggagatgaagattgattccatagaaaagttcaataaccccacagctagtaaaatgtcactccctatgctcttggaggcactcctacacagttaatctattgcagtatagcctgccaccctttcctcctttccttcccacagcccctggcaactctagggatgtttagctgatcctcttaggagcactgaactcagaggcatacacaggggcacttgggtgtttatccacagtgtggagccagcatgtgtgcagaaagggtgcaagctttaagagagaccactggtcaaatcctgattttttcacttctattggattcccactcagctaatccacacacactccataagactcagttttcttatgtgtaaagcggggattatgacatgcatgattgatagcaatcaatctgacaaggagagcttagtgagatttaagatttaaaatgatcagcacaatatcaacatccttttagcttcttccccaagattggttacaatggagactttaaagagtttaagggcaacacctttgtctaattcgtcttctcatgcttgatgcttagcacatgctaggcatagactaggtggtcaataaatgattacttgctcagctgggtagatcagttcgagggtcagtgatcattagattccgatctcctccacagctccgctgtgtgaattggggcaaaatactccactccttttagccttggtttccccacccataggtggggataacaggaccaactcatgggcttctgagaactaaacgagaaataaatggaagctaccactatccagtggtagtgggagatacaaagaagtttcatagaggacattagtcaggggaatatcatcaagtataaaattgagatcagataaatgatatacaattaactatgaatattgagcccaattgtgtagtttatgttgccattaaataattctgaaaacaaagccattgccagcagggttaatgtgataaagtgggaggcagaccgtttcatgtatgctacccccatcttccctcttgtctccgccctctcccttcctgctcccacctcacctcacccctggatgattccagatacacagagaatttggtggcaaagaggtgagggcagtaagaaaaagttctgaatccttggcttcaagtgtttggcgaggcagaatggcattaaagggagagaaaagaaaactgaacagcacctattatccagtcctgagttttccaactagtggactccagtgtatgaaatattgattccctcagccttctggaaattgaggcagcacttggggtcaccaaagacccccagccagttgtcttgggcaccaaaaaattcaggcagtcacccagcacgtcacttgagtagtgtcattttctaagtgtgccagagcacaaacaggtttggaacaataagcaatgacccagatgtccccaaaacacttaaactatggaaacagaggagagatgggattttgatgagaatcaaagatgatgtaatttcaaggctgataaagagtcctcttgccacccatccccaagttcccctgccttcagtactgcaatgtttaggcaaaagactgaaaagttgtacattttctaaatcaaaatgtaaattaaggtatcatctttttcttcttggagagggaaataaactataaaaagtaggctagctgagccccaaagccacaagggatttgacagagaaggaaacatgagcaaaagttggaagcctgaagacactgagggcaaactgcaccattctgccttggctgtgggcgcacatcacacacagacacctcagcagggcccaggaggaggactttgtccctaagactagcgggcaagagccaggtgagaccactgtgcccaagagtggtcaagggagagttcgggaaggaagagccgggcctgatctctaaataatgagtaggaagagtctggagagacagaaaggacaagggccttctctctgaagaagatgattaccttctaactctcactgcgtctgtcttgaaggttgtaaatcagactcttggcccatttacagagacagacactgctgagttccttccagcacctggtatgacatattaactcatggaaaggtggagaaatcctgctagtctaatgataacaataataataacaataattgcttatatttattagacaccttctatggacaagaccagtaaggagtactttatattaaactttagttaatcttcaccgtaatctaatgaagtagggtccttattatacccattttacagatgaagaaaccaagacttcccagcaagaaagtgggaaaactggagtaagaatacagacaccagaagtaagagaaaatcgtggggaaaataggaaagaagagggactagagagacatagtaccaaagacacataatcccagccccatctgttttctagagccaaggcaggcaaaaaggaggatcacctgttctctcctcattaaaaaaaacagtaacccctagcaggaaagtttgaggtaggcatgtgaccggcttgtggaggagagagaatttgatgattacctgttacgtttgtgtctgcaataataatttcatccacatagaacaggcccgtctcctgggccagagggagaaggttgatctgatgaaccagcactggggagtttgccggagggggctggagatccccgaagcaacgcacacaagtctcccagaggtcagtgcaatcgaactgccagctgaaaaacagcatggagcagaactgggctctcagggagcacttgcagtcctctccggttagagcccttgttcccaacctggggggcctgtgagctatgcagccaggagagagaccccatgaacccctgcacccaagcagtcctgggtgccaaggctacaaacatcccacccaagatgggatcagctcagccttggttataatgctagtagtcaccttttaagtcaatcattcatccatgacatgcaatgtcagcagcattttcaaattacagtttaactgtgtgtcttaagcaaattataatgtgaggctgtaaccacagagaagattgatacttctggacattaccagtttcatttaggtttaagaccatttacaagacccatgagaattatgtggaaagcactgaatcaagggatcaagacagctgaattttattccagggtcactagctgaatgaattttgatgaatcacaaattcttggggccccaaatttcctctttctgtcatgtcaaagaatgttctctaaggtttcccccaactacgctgttctacaattctatccctatgagaaatgtcagactccctctagggagtagtatattcttaacaactaactgctctggagtcaaacttttttgtcaaataaaatatattcaaatccccaaattagtgtatgaggcccaaatataagaccattagtgcctgaggtgggtaactgtccccaaaacagtgaatcctcccagctgactgaattcccaccacgcctccccaccgattagctacctctcggggctggtcctcgtgagactccagtcacaggtggtattctttaccatgttttgaaagccgattgtgaaggacacaatcatcttcaggatcttgttcatgtggcctttgtatgcaagacacagctatggacaccaaataagtccttcagttctattagtgcaagaagcagtcattcaaacaatacgtagtgaggagtccacatccctagaaccctgccataggctctgagagagtcagcacagttcctgcccttccagagcttaccagtgtagccagagagacaaataacttaaattgttatttccctacctaaataaagctaaggaaaaatacaataaatactttttctgagaccaaaaaaatgtcatcaaacagagtttttaaatgcttagcactgtgcttggcagtgaggattttagagtatctcacttaagaaaacccctgttctaacccaattacccgtgcaacctcgagcaagtaactcaacctctctgagcctcagttcctcaactctaactccccagcatccttggtttctaactcagttaaaggcaaagctgttgccacaagaagactttagagcaggagttttcagcctcggcactatcaatattctaggggctggataattctttgtcataggggctgttctgtgcattataggatgttcaacagcttccctggcctccacccaccagatgccaatagcacttccccagttgcaacaacgaaaactgtctccatacattgccaactcttccctggggggcaaaatcacctccactgggcgcccctgcagaagagatgaggctgaagaagggaggagctcaagcctgaaacatttagccccaactcccacagcagcccaactaggaaaagactagaaactactgccatgagctccaccactccagcaaaactcactctggttcccaaagggcaaatcagctgcacttcttttacaagggtggtggagctatcgaagcaaaggatttaagaagtgtttgcgaaatgcatcagacaattcaatccatcaataatgacaacaactagagtaataataattagccttcactgggtcctaactgtgcaggcactttactagattatctcatttaatctataccacagtcctgagagatagaccacattactgtccattttacagatgagtaaatgaaggcatactgtacttaagacagacatggaaggtacattgggtgtggaatcaggatttaaaaccagatagtccaatgacacagtctgtactcttagagatcaaagaaaatattgtagcaaataaaaactttcacaagtctcacagctaatacaaaggcatttccaggtaacaacacacaagtgggggccagtggtgtccattcatacctgaaacagcagtcgagagacctagaacctcagcctgaaacaccttgggcagatcacagcaatcactcctttgtgcttctgagttttcagtcttgaatccagagagcaataccaatacctacccacctgacccagaagcacaaagactgctactcacgtgtgtatactgatctagccgatagcccttctgggcagccgggggagtaaggacaaggtgtcgaggctgacggaggctgaacctgccacagaagggctccgtcccactggtgaggtccccatcagagttggaaacttctgggcctggatgcagttcagataaaatagaaaggcaggcatagatattaaaaaagacagagcttccctacatgtgtgcatgaggattttagagtatctcacttaagaaaacccccgttctaacccaattacccatgcaaccttgagtaagtaactcaacctctctgagcctcagttcctcaactctaactcccccagcatccttggtttctaactcagggacaaagttgttggcacaagaagactttagagcaggagttttcaacctcagcactattaatattttaggggctggataattctttgttgtaggggctgtcctgttcaccatgatatgggcccctcagccctgggaggaatggccacagcatgagtggtcagcacccctggcttgaaagctccagctataagaaactcattctgtgttccctggagccttgaaaaccctttagcattttctctgtgtagcaggatacggaaaactattgagaagcaaaaagacaaggaatatcaagatggaagaggtgttcaaaaataactagaatttagttcgccttagtagtagttttaaaaacataccctaacattttaagaatttcttaagactactttcttaagtagtaattcctttagatgtaatctgaagattagcatggttttggctatgtttgcatgtttctcacctatgtctttgaccttttcccaccgtgtggcatggggagtataggagggtgctgcactctacctaacagcccaggaggaatgcctttcctttctattgacacccaccgagcatcaacctcccaagcacagtgcagtgccagtccctcagccactcagtgtccaaatccaggtttcatattttttttttactctgttatcaccttggagaggaaatggggattgttctcattttatagaaagaaagaagaccatgatgaaaaagacaatcagaatgaagccacggacagcacctcgttcaaatccaagccggagaaggatgttagaccaaaggggttccagtttgcattttactgcaagtaactcctcaatggttgtttgaatctattacaaaggaaaaaaatgccaggaatttatatcatgagcataaagaccacccccagttctcccactcccctccctcattttttgaagaagtctcccaccagatgggctgtggcatttgcagggattggctgactagagacattgtcccaagtaaggaagaagtttcctctgcctgatacattcagcacctaaaaaagtcaagacagacaagactaaatgatggtgctaattaagccagagagacaatctaagaacacaggacattcctcctcaacttgctatttcctttttattataattttaacttttcaatgctttaacattcagaaatctctgaggaacacagcatcattgcctaatgagaacttttgttggactaacagagatgtcagtcttcctatttatctgtgccccttgattgagagtatgagatgtaacagttgccattgaatgctgcactttcagcccctctcaccaattgctttctcccaagggtagcccagcaggcagaagcagctccatggcatgcaccctctcttggaggcttatgcagtctctgctttgcttccaacacatcaacacattccctgtagggcacattatagttttgctactgagtaagttctatgcagcttttttttttttagatggagtttcactctgtcaccaggctggaatgctgtggcgtgatgccggctcactgcaacctccgactccctggttcaagcaattctcctgcctcagcctcccaagtagctgtgattacaggcacatgccaccatgcccagctaatttttgtatttttagtagagatggggtttcatcatgttggccaggatggtctcgatcacttgaccttgtgatcagcccgccttggcctcccaaagtgctgggattacatgcgtgagccaccacacctggccagcttttaatctcttaaatcaattgttactttctactttgttctatggttatttgtgcacatgttttacttttagactgtaagctttagagggcagagttcatattgatttgtctttgtacaccaaaaagtgaacaacaaaaactataacacataaaaactcttcaaagaaaatatggggcacagctgagagacccaaaggacatgaccttttcaaagtagacttagaaaacacaggctatagggaaataggacctcaatcagtcaaaaattatggaatttaatgtgtatatgctcacatgcatgcacgcatacatgtcgggcgtgtgtttagaggaccttgtctcttttctgggaaataagtttctaaaagaagacttgcttggaacttaaattcctaaaactaactcaatgagtaagataatctcaggaataagacatcacatttttgtaaacatcttcacaatgctgttaaagagatatcctatttctttgacagcaaggttataatgacccctcaggtcgccagactcccagtcagtgctcctgctacatgggactttattccttccagagttcagctccatgggactggaaagagacacagacctgtacttctggaagcctctgggctcggactcggatctggtgcttctcccgtaggtaagtggtgaccacatcaggattcagccaggtgttgtgaatctggacaccaatcctcatccccctgcttggggctatcccatgatgctctgcttccaggtagtacatggctccacccaacagctccaacttgggagtcttctgctgccaggtcccttcatccctattctgctcccaggagtcaaaccagtcagcagtgccgacgctgatggaggccactttcacctatgcccaaataagcatatcatgatcaatactatgcagcttccaggcatctctttctcaaacactaagtgtctgaactgctactatcaagagagttttgaactggtctgcctttttaacatattaacccagttacctcagccctgtggttatttatgcttctccagctctctatctatctatctatctatctatctatctatctatctcttacaattgagtagtactcaaatgagaatagatgggccatgttcagagaaggaacaaccaacctaaaccctaggattacatgacactatggagaaggtagtattaagcccttcagagacctcgaatgacttgatcacatcaaaatctatgacatttctccaataaactagcaaatcaatttcagacatacatagtaataatttgaggaaaatattgtgattctttgtcaatagcataagtgcattttggctgctgttaaaggcatcttttcttatccttcaatgttgttgaggaattcctacatacagctgcctacatctccacccaaaattagtggaaaaggcacaagttttgtagtcaggtaaatttggggttgaatcctcaatgtgccttttgctatccaagtggattgggcacacaatctttcttttttttctttttctttttcttttttttttttttttttttttttgagacaaggtctcactctgttgcccagactggagtgcagtggcagccacgactgcccaaggctcaggtgatcctcctgcctcagcccctcaagtagttgggactataggcatgcgccaccatgcctggctaatttttgtatttttaatagagacagggttttatcatgttgcccaggctggtctcaaactcctgggctcaagtgatctgcctgcctcagcctcccaaagcactaggattacaggaatgagccaccacacctggcccacacaatctttccaagcctcaatttcttcatgtggaaaagatacatacatatatctttatgtatatatgtgtatatacacacaaacacatacataatatatatacatatatacatacatacatacattttgcagagatgcagtgaaaactagagacaaggtctataaaagatgtagcataatatttggcttacagtaaatgctcaataaatagtacgttcacattcaaacaagttctttttcaacaattaaagttcctgatcatccaatggcatgttaaactatctgtaaaacatgagagccttaactttgattctttctttcttcatgggtatgggactggcaacagagaaaaggaaaatgagaagacagtgaataccttagtccttggttcctctgaccaactgaaatgcaaggaagcttggctatctgcctgaatccagaaagtgtaattatttgtctctggagccacaaagaacccactgagccgtgctctgtaaagtagaacatagagtcaagcaagagtaaccaaggcctgaatcactgaaccaacaaatgactgcccttgtactttgtcttcttttatggtaataaagaagaacaacctgattcttatgccacacaattgtccagaatattctagaaagagatatagcacctgcctagtctcagtagcccaatacatctctacactggacacaaatacccttgctgttgtgtcatgtttgggaaagttgtagccacagcacacagctatacggaagcttagctgacaaaaccacctaacacagctattgcaagccctggatcatggtagaagctcaatctatagtaaatactattcttattattagaaataaagacagattgcttatgagaatttgctctgagcttaccagctacctcaacacctgcagagagcatttttctaattaaaaatattatgatccacagataagcgtcaattcaaaatgtcaacaatttcaaattaaaacccatcaaatgcaactttgaagaagattacaggcaatttcataaaacattttttaaaagataatatttttaatatttaaattccagcaacctaatattataggcagatatagttaaagaactgattagactctgtaaataaataccaagaatattttctgataatgctattttcttaaatcttcagatgatcaatataaagatgtttttaaattttgctttaatgtacatacattatctttatttttgagataatttcatacctaaaaatagcttcaaacataactactttaaaagtccacaatataattatattaacttaccaataaatgaatattttaattttttaatttaaaatttttagattttaaagagattaatgagagagggaatggaaaattagttactacctggcttgtggttcctcaaaatggcagttaaagggacataccctgcaacacttactatagaagtcaaaatgttcttttgccttttggggtaggctgactcactccttaacactcccaaatacaccaaatgcagctgaaagattttcctttgaacattattaaatggtcgttaaaaactatgataaatatgaattattaggtgctacaatggaccacaaattaactgccacatttttgtttatttgtttctttgtttaaagacagagtctcactctgttgcccaggctggagtgcagtggtgtgatcatggctcgctgcagccctaactcctgagctcaaacaattctccacttcagcctctcaagtagctacaggtgcacaccatcacacctggctaattttttattttttacgttttagagacagggcctagtcccaaactcctagactcaggcgatcctcctgtctcagcctcccaagtagatgggattacaggctcaagccatagcatccagccttaactgccactttaaaaccataaactcatggttaagtacctagtaagtaaggcttcaggagacactttcctgctcacagattaccaaccctacttggcttattcaatgcctaaaaattctctaagcttttctttacacaactgagttgaaatctattagattggtgcaaaagtaattgcggtttttgccattaccttcaacggtaaaaaccgcaattacttttgcaccaacctaataaaatggtaaaatatttggaggaggtcacagactgactgaaattcacactcatgagtcacagtcatcctctctaagaaggatttcaaagggaaaagagatccatcattcagtaaaggatccatccttcaacatatacactgagaacacactaaggaaacagtgtgtctaagcaattttcaagcttttatatttttaagtttactttagaatactagaaattttggctacatccttgaagggactaaaaagactaaaggaattacacaccattaaacaggaaaattagaatcatgatgccatcactactactgaaaacaatgtctcacagaacccgcaagagcttcccctactatacaagggccattgggttgaccttcagcactggaaggctgttcctacagcatgctgcctaggctttgctccctcatgtacccaaagggcaaattcttggatctttctttggcatcaaccagatgttagttttacctcttaaccaggtacctaaagcatgttttactctgctgtctttccagtctcctggcctgctcagctcaatgttctagttgataatcatctccaaaacagattgtaaactaagttgtggaaaatatacatattacatattgatcaaaatttgtccctgcactagcatgaccaacactgattgagaatactgtcaaactctgttgttgttgaattggctagtgttataaattcctggaaatcttgataccttccttatctgtctcctagcctcacctaggttagcaaaggtgcttttgatgtgggctcccacttttcctacaacatacctgaaaggttgtccttcctgtgaccaaaacccaaatggagaactggcattagggacaatctgccacctgtaccctggggtggcttcagtcagttccagtccctcaacagcatctccaacttcaaaaagaagccctcgattgcctgtaagacatgtagatcgcataaacattacagggcgcaccttcccaaattggggaattactttattttaaattacaaggtgaaagatgacccagatgctacctgtaaaggtaagtcaacctagagccagatagagtagttatatgaaaggttctgtagttaatatgaaatacaaatgttccggaaagtaataaacattccatgggttaggagttagccttttttagcaagagttcctagaaaagagaatcaagtcctggagaaaatgtgaattgaatgagcaaacagaagctgaggctgagtaaaaggaggacaatgtgactgtgtgctggtgacgtggcttggctttgtgcttcccaaagccagaagtgggcttcagtatcttttaagtcccagttctgctgtgaaattcaattctctaaagtcttttttccccataacattggcaatccttaagtttctcaagtgtcatggcctcaatttgtggacctgcacacagagccaaatatgtggcatgctgctattatgtgacattttaaatgatattgtattaatttatattttgtgttaagcaaaccctgaggccaaaggcacaggtgcaatcaatattgaatgctaacttgggctgaaggcaaaactctggaatcccagctagacgtgtagctttgagcaaattccttgatgtccttgcatcttcattttctcatgcatcaaaatgggaccaataataaaatagcaataatacactaggaccaagggaaaatatatactcaaagagcctggaatacagtaagtgctcaataaaggtaattatggtaattattattttaaactaatactgttgttcctcaacaactcctaaaagggagaggtggataaggaataaacagaaaagtaagagcatattttgaaaatattactttaaaccagggtttctccaccccagcactattgatattttaggctgggtaactgttgtgagggggtgtcctatgcattgcacaatgtctagcagccttcccagcctcagcccactagatgtcagtatcatcaccaccaccaccacttccggtctaacagccaaacatgtttctacacattgctacgtgtcccccgaggggcaacattgcccctggttgagaacaattggtttccatagtaattcgcccagcttctgtggaagaaacttcaaaagcccttcataaaggacaacactaactgtcaaaccagctgcattcaggaaattatcctaccactacccaagtagctaaagcaggaaatactgaaaaagggagcagactctctatttcctgacaggaaacacacattatcttgattacttgtttcagtagttttgtttccttggatggaagctttccctgagtaaaaactgcagatctgggagctggagaattctcaagccaaaactttgcatgcattttcacacctgaatgccctttctttagaaaggtttcttcccctgctgggcaactttccttgtaggtgctgtgcctctagagttgactctcgctgcctgtagtttaaccattaagtcaggcccttgggcacagatgtgcagcctgtggttcttggctgagtaacataccaactgcccttcatccctgactacacttgagccttcagttctaatgctcagcagaaaagtgctccagtattgtgctcttaatttgctgctgtagggtggatgctttaaacagagaaggacagctggaagctcccttgcctcctccatttctgcccacttcaggcataacctggtggcaacatcacaatatatccctgtttctcaaagcagcagacagatgcccacaagagagaaaaattcatatttaaatgcatcccattgtgccctactctccgaccttgtctaatgctgttgttttgagcatagcagagcacactctaacgctcctgtcttcttagccagtggacgtgcaactgacccattgaatgaaggcgggcagtttgggggtttcttccagtagctataacaatatcttgagggcagttatgctttctagaccatggtctcttctggacgccactggccatacagctggctggagctagaagtgcaatgtcactaagcacctgaataaagctaagagccttcctgaaaggagagccttgacaatggtatcatggacccagggctcactgagtaagccagtcaaatagatgagaaagaattcaaacacttttatttctactcgccagcccatcatgattaaagatattcagagtttattgaacagccctggtggcttccttacctggctgaggggtggtgagcctcacatcttttcctggagcccgagtggtgcactcaatcttcctgggagacacgtgtctaatatcacatggaatgcctaaagcgaattaaagaaatttatgtatgtgtgtgtgtgtaggtatacatatatatgtatatgtgtgtgggtatatgtataattatatatatatatatatatatatatatatatatatagagagagagagagagagagagagagagacagagagagagagaggcagtcgggagatgtgatggcaagaccagactgaagtagacaggctcctattctaaggcaaagggctgggtgtggatggaatagcgaaagttgtcaccccaattgaaggagaaaagagagagtgcagagcagcagagcatagggcagcgtggagtattcagaaggaaagccatgcaatggagtgctcttcattggggacgtactgaaccacctaactgagcatgggaggtaagtgtgacatgacagtgtgaggacacccttggtgtcaccaactacagaggcatcccacctgctacaggacctggcaaaacaaaaggctctagacaggtccataaaagggtttgccaaggttggggtgcgggggatttccagagtaatctgcatagcaaatgcccacccactcctgcttgtctatatcaagacagctaacaagggagagtgaagagaggggctgtttttagtagaagtaaacctttgtcaagaaggagctgtatttctttctttctcttcactcacaagataggggcacctgagggaattgcctatgcattgtgagtgtgtctgcaggacattccattcctgtgacccatgtactgtaggaccaaaatcccacctggtctcaaccaaacacatgacttatcaaacatgatgagtcagaaggggcaaagcttgcttcctcctgcatccctcatgccatacagacatataatctcctagagcatctaaaactatgaactattttcagccatttcatcatagttacctgcaatggtaacctgggcagaattgtcaaaaaagtctcctgtaattgtgatgtttgttcttcccccaaggctcccagtttctggaaacacagataatatttctgcaagagttaaaaaaaaaaaaaagtaagcttccaaatatagaccagaatatgacctagataataatataataataggagatattaataatttcttactttaactttctaagtccagcaacagttgaatttttttctagtaataactatttaaaaatgcacataataagaaaaagaccagaagtatatattatcgaggatcaatatttgaaaggaaggggaaatgtggaatcattcatggtatcagcaaaagcccctagtaccatgacattttctcagaaaatctgtctcctgacctcaaggacaatattgacaagtcagggaacagtaagttacaacacaaggaggaatcaactttgggtacactgggaaaggcttcagttcacccatatgaatctgtaatttgctctaagcagaagaatgaatttcactgtctttaggaccctcccactctttcccacactgaatgctccttccccacatgtacctcacacctcatacccagttctttcatgctgctcctgattgtttaaaattgcctacagtgactcaggcctgtaatcccagaactttgggaggccgaagcgagtggcaggtggatcacctgaggtcaggagtttgagaccaacatgaccaatatggtgaaaccctgtctcttctaaaaatacaaaaattagccgggttccgtggtgtgcacctgtaatcccagctgcttgggaggctgagacaggagaattgcttgaacccaggaggcggaggttgcactgagccaagatggtgccactgcactccagcctgcgtgacagagcgagaccctgtctcaagaaaaaataaaataaaaaatttaaaaaaagaaattacctacagtaatatgacacatagtcctcagaatttagctttatctcattctttcctctcctacgatcaagctttgacatttctaagattcattccctccagagaaaagaggagttgcattttgtgtaaactgaaggtacaaaagctaatgatgaatggttacccctgaaaaatagacattttaggaggttattttataatgctttttgcccatgagacaaagcagaggagacatatggaggcaaagattgatcccttacactcagataccaaaattcaccactaaaccataataaccccctgcttttaacccactattttataatttctttttttttacactagcactggaattttgtatcagctttacgtagagattaacacattcttttgttatgcattcaaaattacacagatcaaaaacaaaatttatgaagttcttaaacttttaacatagttgtagatatttgataatttttttcaacattcacagagcacctattatatggtactaggaatataaagatgaatacaaaatagttcctgtcctcgagaagatcagcatggtaaggcaggtatgcaaaactatcatttaataccttgggtcggagaaattagagagtatatgaaagaatagagaactttgggagtaggatgggagtattgaggtgtagaagaaaatgtttagagatgacactaatctgagtcttaaaggatgaattagaagtggcctagcgaagaggagaaggagagggcatttaaagcaaaagatagcctgagtgtggacagaagaaattgcacagtgcatgttaagtgtggctggagtatgagagacagagataaagctggagaaacagacaaggaggaggtcagaagtttgccccatttccagtaggggatagcaagccataagaggatggtgaataggaaggaaccatgcatcagatatatgcttgatgtagagaaagccagggaggggcttgaaggggcagagggcaagtcagggcctctagaaaccactgcagcatgtaacacaagaggtgatggggtccagaaatggagagttgctgtacagatacatcataaataagagagaaaactggcagaaattggtgattgaacagatatggaaaggaggaggaaggagaaattttagatgaattccaagattcttgctcctctacctctttagacgacttttggaataagaaggataagcaccactttgtcagttttagagatgcttaattaaggctcaaaaagcttaaaaggcttaactagtgattgaatgtcagcccctgaggagctcagcccagggctcttcatggctgtctacaccctctcttcctacagcctgctctgctgtgaagaagttctggcctgtgagtcctgatcccaagaagacactgccctggaaatgtaaaagagctgtgtcatcagagatacctgtcagcctatcagtcattctagggtttgatagcaatgggcaggctcacaaaaaccttggagtggagtggcaagaagagtgtgcttcccaccatatattggctatggacataagatttggaattagaactacacattctagctctaagacctttggctttggacaagatactttgtttatctgagtctgtttccttatctgtaaaatggggctaatgttaatccatctcatagttaagtgaaattaatattgagattgtatgtaagacacttaacaaggtctgacattctttctatagcagctatcgttatcaccatcaccttgggcgcttcttcaaacttaccccaaatagactagcaatactgttgaaagaaaggaaaaatcagggtcaaaatgcagctgttgcaggattaggctatctagagagtaaatgacattttctccatgacctgtgaattatcttgcacttttgacaaaggtagattttgattgcttctggaatctgaaccaaccccacagacatttcttcagtggctgtgtgactgtattccattctagaatctaagtattctttagtagccagctttctactaccaaatcgagttcacaattccaagcaagcttccaattttcacattcatttttttagtatgagggtttactcatcagatggcaacagaacagcttaatatcaatattagtcataaattattgaatgaatgctcagagatggatgttaaagtaactggaaagatgtgctttaagactttttaagtgccaccttttttcttttactttcagaagacagaataaggcaagactctcctttcttttattcagtttatatccatagaatttgtatagaagtttattatcaagtctcttttaatatattaactaaacctgacatggatacaagcaatttaatctcaaccaaaaacaccaggctgtctatgattgtagggacagcttcgggtgttaatggtcatcaagaaatggccaaaagatagggaaggaggggccaacattgagtgaggcacaagggaaggggtacttggtgaagggggatagtacctgagtgtgtctggtataggaaaagatcctgtttagcactgatcagccatgccttcttgtggaccattgaccttcgaaaaagacaaagttctgttttgaatgaaaatatcaactgggattgcattttttttagtcggctgcctgaaaggaagattgggaactaacctctattgatctttagaacagttgaaatagcagctcccttggataactaaagaacaataccaacaggacaaagttgttttctgatatataaaattatcatatgggaataatgcctgcttcataggatgtcccaaatgttcaatgaaatgatgagtgtgaaagggcctagtccttagttggcctatagtcaatactcaatagacattaattttatttcttccaaaatgagaaagagagaaaatctccatactttgggctgtatagctataattgtcactgtcattacaaggcaattattatcaattagaccctacgcttttaacagaaacacctgtcaaattatgtaggggcaaaatataaggtaaggattcagaattccagaatgctaatttatcacttcaaagtgtgataaaatgtggaccccttccattttcaagaaggcacttcctagatggtacaatgtatttcatgaaaccatgttccttataagatacttgtgacagttttcaacctacagtactttgaaattacttaagatttaattcccaaaattctgcaacaccaccatattgaaacacacattgcctacagattagtgaagaggacacaacttcattcacccaggtaaaaaagtcaaggagttatatgtggtctcattatactattctgtttttatatgtttaacattttccgtcataaaaagataaagaaagtaagcaagatgagagagataggtaatataaaatgaagacaaatttgcctatttctatacccagttacttactttcctttgttaaatactgagaagctaacattctgggagcctgtaacacaaagaaacacacattaactcaggaatctgcacgagtcttctgggccaggccattgctttcataagcccaaagactccaatatcatcaaattaccacccaaacctgtaatttctttagtggttcccccccgcaaaaacaaacaaacaaacaaaaaaacaaaaacaaaaaaaaaacacctcataagtttagcatcattagcaatgtggacttctagcaataaaagggcaaatgcagtattgcatagcagggaagagcccaggcttcgagttagatggagcaccatttaaatattgatttactggtaactaacttcaatttttctcacctgcaaagccaaaaataataccaccaacttcacaggtgtatgtgagcattaaattagtttctatatgagctgtttcatatagtagtattttccagggaattcttaacaaatagtaattattgttattattattatcctcatgagaaccaatcttgcaattgcttttgtccggatacagagaaagaaatggataagactttaaaattatgttacttctctaacagaccgatgtagtcgccttccacatggcactgcagagtcccaagaccatggtcctcctgaataggataactaaggaaaagacaaactgaggtaagaatgaccagacaactcactaccagaagatctgactctttaaccaggaaagtagaaagcaaaagaaaaccaaatttgctagagaaaatggtagacagagaaagtataatgagttcattagggcaaatgcttagggtaatactaactagtattaccctttatatatactagttagtaataccctaagcatttgccctagtgctaactagtactaccttaagcatttggtcctttcttttcaaatgtgtcatatgacaagtataacaaaacctttatttttaaaaaatctgttatcaagtatgaaccccataaaggacaattctgagcaaacaaaatgcagacacaaggaagactacacacaagggcagaatacacaccagtctgaaaaagtgaaaccatagagtatcattcttgtaatggcctcaaaggaggggcaacacaccctgtccagagtgaagtaaaaatccagcaaaacattgggtatttaaactggagagtgtagaaacttatttctaaattttttattatttttacctttggctagtcactgaagtatagtggttaagatcatgaactctaggggatgattagttagacagggttcaaatcccaggtctgccacttgctctctgtgagaccttgtgcaagttacttaacttttctgtgtctcaaattcctcatctataatgtgagactaataaccatacatactcccaagattattgggtgacttcaatgtaaagcattcgagcagagcttggcctatggtaagcccctaacaagtattagctatgtgttttcaaggaaggttttggcatccacttcaatacgcactttgaatcaatccctgtgtctttttcagtagtctaaagataaggtagtaaatagctatgtgtgatttatattttaaaaaaacagatatatggtgagtggggagagaaagagagagaatgtgtgtgtgttgtatccatgtggacgaacttacaagcatgtgcattggcaagataataagacactcaccagcttcccatctgcctatttataagagagcaaggagtaacccatttgtctccttgagcttccaagatcactgggctggatttaaaaaaaaatgaaaacaaaagacaagagataattgtgcaatactcccaataaacattcctcacaaaactcagaggaaacatggctatgaacactctcctctggatttttctgcactattgcaggtggctgaaggcggatgtcaagtcaaattctcagcagagagtagggatgcactcatggctcatgctttcacactaaacagaaaatagttctcccttcccaaaaaaccttcatcatctccacactggctatattgattctacacagagataatattgcatttatgcctttattccccctttcaaaggctgtatcccagaccaaggctgagatgggatcacctagcaaaatatggcacattcccaaggatgtagtaggagtttctaccccccacaagaagagtagttttcttgtaaggtaagttgaccattgcttaatgccagaaatgtcaatcctgagagtaataagatcatattctcttcaactagggcaaaatcagacagatggagtagaacagaagaggatgcccccaacccatccagagtgaaggaaaaattagacaccatgtatggaatctatgcagctgagtatatagtaagatcattttccttctaccttataaatgctcagtacaattgcttcatttgttgaatgattacagttgcttagagcttcctacagcctctacaatttcaacactttttgtcttgttctctctctccagtgtggatgatttaatagtaacactttccaccacgtctccagtgaagaaagtcatgttgacatcctaatcattcccagaaaacattaaaagctctatggcttttaatacctgtgtccatgttttcctctgaccccactaatacaatttttaaagcacaaatggataacaaccaaataagaaagttataatgggcttttgggtttacacatcattttataaagaatctatttcaggctgagaaacaaaggaaggaagggtgagaattcaaaaagaaaatccacagatgcaattacagttcatttcacactgagcccagagtgactagttgtcagtaaataaatggaccaacttaattgaccagttgcaattacattaacaaagtttgctgaagcccagctcatgagggaccataaactgcaaaaaggaaaatagcaattctgtgccaactgcttacaatttattgccatcagggaagctggtcccaggaagccatgcagcatgtatgtaactagttaaacacaaaaacaaacacacacttacctatcaatgtactcagcatcaaaatcaaaagtttccaatcttccagtgataatccagccatatacatgtattagttttcctgtttgaagaagaatttttttaatttaatggacttagctcaaactcaatgtataataaaaaaccatgtttctttttggttgtatatactcaatatggcaaagcaggtcatggcccagaaaattaatacttttaataaattgtacaacagtaaggtcaagggtatgatttagtgatcaatattacacaatataaaagctaaaataagcaattgtttcaatcacagacttaatcttctaatgcatggagcatagaaggaataatgggtcttcttcacagtctcagattgtgtgaacatttcagaaaggaggggctcatctccacacactgccctgttccattctcttggctctgtggagaccatctacccaacacgagatttaaggacaatgtgccttgggtgctccaggcttcatgagactttcctctgggcatttgctaaaatgaacatgtgatatgaagaggctcatatcacacaatctgatgggtcttcagggatcccaagtatgtgccttccaaataattagaatatttaaccatgtatacttaaaccatcacagacaatgtttagagataaaagaatgttggttagtgagataaacctcaaggaatagaagagaaaagcatactgagggactcatgaggtcatgaaatccagaagactgagcctctttatagacactgaatgccaccaaagaatgtgacaaaaaagatgttcccttcctactgcacttgtgtgttattagtaagaagtgactttcatctgcactcattggatgactctcactaaaacaacagaaatctttcggaaggtattacagccacaattttataggtgcatgggtagaatgacctaatgacaggcaaaggtcacagagttggcagaaatccagagtctcaagtttcctgttactgctaaaaaaaatctggcagaataattctaattttaatagggctaaatgatcgattccctagccttggtgagtatgacttctagctttgacaggcacaattttaaaactaacaaaagactgtagaaattaggaatttctgtgggtttttgttttgtttctaaacgaagatggccagcacaggctgacaaatggccacaccagagcacggtgatgggggattccatgtcgtagtgaaggactgctaaccacgtatagaaacccaactgctcagaaagcatcgtctctcttgtccctaccacctcccccatctccctggctgctacactgggcaggcttcccaaatgaaatgagagtattcatctggaaagtgattacaaagatgcagtcgtatggatcctgcccaggggggaccactccaacccagcccgccaccaatcctttccccagaaggtggaagagacaccgagcagaactccaacttggtggaagaaatgggcttggcagatctgggcgccagctgacattccatttcacacctctaatggctgtctgcttcctcatccctcaccctaacaagacttctgccatctacacaggagtttctaacatcagagcagcagggacccacatgtctgcatgtgattttcacagaccacatccctctttcataaaatatcaggtcccaatgattcagacaaatggaaaggagcagatctgtgaaaaacccacatgagcaagagcatgccaaattcatattctctgaaatataatttaaattcactcatacataatctgtgtctatacacacaaacacagaaaatataaaacgcttttcaataacttagatcttcattttgacatgcttgagcagttgagccaatcaaaacaacaagatccgtctatgcatttagacacaactataataaaaatttagcaactttttagcacactcttaccattttggaaactctaacaaatggaaaaccttaaataaaggtaggaatttggcaggaatcagacagcaaattatatataatcctagttgtgtttgctacttagttttaaggcagatttagcaattcctgaatccacttctcagttgcaatcccttcttttatgtaaatcccccagctttatataatcttcttttctatcctcctggcttttaaatatctgtgtgctctctaactttataaacaaaacccctagatgaagactagagttaatgaccttccaagtggcatccaatgctgctcaaaatatgacagaatggtggatatatgggccactctggattctggctgtctggttcaaatctcagctgtggtatttagtatctatatgactttcggcaaatttcttaaccttttgctacctcatttcttcaactgcaaaatgggaataaaaatagctcttctattatcaggttttggcgaggatctagtaagatatctgaagagcttagactggagcctggcacacagtttaataaaggtttattattatgggaatgattataaagttaaaagcaaggatgactcctctttcctccagtctccaacatcaactcatttgattttgctgtcctctttttcttttcatgtttggattccttttgttatcagtgaagtaatagagcaaaagtgcccagaggtaaaaccaaagcacgttaaaaatgaaccagaggttgactcttattttcaaaacagcatcaaagaagaagttaaattttcccactcataaaaaccactcacctaggtttgcaacaagctttggcaaacagattcacaattattcctattttaatagaagatttcttacctggaacaccacttggtggataaacttggtgaacgatgggtgtctgcgccttggaaaactgtttagaaaatagtaccacaagtgagcatgtcattaaaatattcacaaacacaggaggcacaagcctttcctcagacagcattacttgaaggtaataaatgcttatatttactcatgtcaccctcacatctgtctagttctttttatctttgtaatatttctatgaaacagaaatgatagatattatcatatttctcctatagatgaggtagaggtaatttgattaaggtcacatagccctctattctgtaccatattgtccaaaccttgacaagcctgtttctacctgcccaccttccatacccaagaacacattttactagaaggaaaggtagacaggtctttgtgcagaatgtcagtcttttaattccattgtaatttgatgttttggggccttgaagattttgatttttctagaaaggaatgcacttatttaattgaatcaaaacttcaaatcattatcagccagcaccttggtaggtatcagtaagctacaaaaaaatgagaaactggataggcacacaactgaggtgcttactagggaaactgaagatacctgctgtgagggaaatgactcaaaagattcaaggaatgggaagcaacattgttcttcaaggaggaggaaagcagcctcaatgggagcagtgagagcctgagaaagcctggcggtagcattccaaatcatcttacaatgccccctgtccccaaagcacaccctctgttaaccataagctccacaaaggcagggacaatgcttgactgagtcgctgctgtgtctctgtgcatagactggtatgcagacgacattcgaatttttgtgaatgaaaagagtcacccaatctgggatgactgatatactgcctggaaggagaggtgagaacgaggcaatcccaggaactccatctcacctgtaggcatctgtgttagtctaagattagtgcattactccatcaggaaatcacagcagggccagtatgaagaaacaggaaagcttaaggatgaactggccagaccaaggcttgacctgtgagccaattacttacctaggaagagacctagtctccccttccctcccctcccccaatcccttctagatgcctagactaccaccattccacacaacctacagtgcttcccatttgcaaaacaaattacagcagcaaattgttttgtttggtctgcttccagcacctcaggagtctaccttcccagagagaacatcaccaaagaataactcggttgttaatcaacagccttaatcagattgagaatcaacagacatttcaacaaagctgatggtggcttgccaggcgtaggttttaagtattgatccatatgctgtatagtctgccatgaaggctagtttcctcactgtctaaaggaaagggttagaaaatagttcacagaaaatatgtggtgtcagggggtcaaaataacaatgttgttacttcacagcttgggaactggctctgatctcaccaaaagataaagattaatacagttacacacacacctgccaaacattcagtccccaccccaccctcccagccaaccactgcccctaggccttcatatcaacattatttcaactggactatatcataggagcttagtgaagtacagtagtggttattgacctatttcacagatgtttagaacctgaggcagctggaacaactgagtccaaaccaaataaggaagcatacctctctatttcaacctgaaatctaagagccaccactcagtctataatccttctaccagacttccatgggaaacacagcaactcctttattactccctcccagctcgtgagatcgtggtggggcaggcttggggttaaacctcaaaaagggcttcacttgtgattctctctgagctgacacaacataacatggtacgtttctaagagaaacaggcccctggtcacccaccaggctagagacatgacaaagtgaaaaattaatgagcttccaaatcaagcttcccgcatgctgatcctcgggccccagtgtggtcagtagaagcaaaagaggggagaggaaatgcagcagattaggatgagaaagctgcagccaccagctgtgtgatcaaccttctgtgagttattcaaacttgtcagcgcccacagcaggctctttgcagtggactggcaagatgggattaatttttaatactcatggttccccagtcccagtcccaaaacaaagagacacgccgtgttttatttagcctggaatgcctctcattaactgcatcccctggtgatttttcatcaacttgccaagatagttgaaccactgacggacttgttttctttcatgtgcaattttaggaaacgtttctcttatttccccctctcgctcctaaccaatcttttaataagcaggaaaactaccatctggggtgaaaaggatcatggtgattaatgcttggacttctctcttctgttatgttccctgagacaggatagaggtggtggtgcagctcttagtaaaaaagaatgatataatgttttttctttctgctgcatatgtgcaaaagcaaaattccagaaaacaagattctcttggattaagaaacaagttattaaacctgaaacaacagcaaattccaaatttcaaaaccaaatagcctatatgaaacacggatcgtaggagagacaaatttacaaggtgaagccttattccgaaggagcattcattagtgactgcattgtatgttttgaaacagctcttaaacagaggtaccccatgtgaagggcaaccacatcgacaggagtaccgccaaatctctgcctttcataaaccatctaggaccttttcagagattgtttaaaactaatctgaaatgaacaacagactgaaccaaatataaatgaactcccagtataggtatcaaggctgtaaaataagtcaggcatggcttcctaaacactctctctctacttcctttttgatctccctgagcatgaaggagaattccagcagcaaatgcccttttggttcagtgttggaaagacttagcagaaatataccaggaagcagggagagaggtagaaattgggtctcctcaccaaggaacgtggggccttgagtctcttcaacatgctgagactcagcatgatctgagctgtaaaatgaaacacccacaaaagtaatcttggtggcccctctatgggcttctattttgatgagaatttagaaccagatgcaagttgaagtcttggttctgccatttactgcctgatgacatgggcaaattatttaatcaccctgagcctcagattgttcatttgtaaaaacaggacagtaaatagctaccccataaaattgtgagcattgaatcaaatgatgtacataaagcatttagctaaaggctgacatacaaacgttcaaaattcatctttcattagtataatataagaaactctgtcattaccatccaccattttcttttaacccggtcaagcagacacgctggctcatttacaatttgcctttcaataacacaagcacacccttagactatgtaaacataccttcctccagccttagaacccaccttgaaagtacagctatctcgtggtcctggatttggactgcttaccagctgtcccccgaagtatgcttccaggaagtacagaccctcatgtgcttcagacagcacagatctgaggacagaaagtggaaatccttatgaatcaaaaaccatgaattcccaaagctagcagcccacttgccacttcaaatttcctccttgcacttttaaaacagagctaaccaaggattcccagcagtcacctttcacctctttgatccactcataattattagactttaagaactgggtccttcagcaaaaaaaagttatgattttttgtgttgaaactccctgaattgtttttaatatgtcatgtttctcaaaatcataggttcattggactttaagaattagaagagactttgataatctattccccatttccatgtttcaaaaaatgtcagaaaaactaagagacttatgtgtatgagcttcaaacgttaagggcaaagtggggcttgaatttaggctctttctgataattgtccaagcagcccataaatacttcatgtagccatcaaaacagagtcttggatcttctctcctctttatacaaatattgcagtggcttcattgccacctgatgctgacatccatgttgatttttgtaagaggaagaatatgactaataagaaagaaaccatatttaagacatgcctcctctccaaaccttcccaacaaaatctttagtatgaccttaaatatttagatctgaattgtccattgtgttagccactagtcttatgtgcttatcaagcacttgatatgtgggtagtcccaattaagatatgccatgattataacatgcacactaaattttgaagacttggtatacaaaaaagatataaaagtatctcattattaatttatatagattacatattgaaataatattttagatatgttgagttaaataaaatacattattaaattaatttcacttgtttcttttgactttttcaagtggctaaatagaaaattttaaattacatttgtgttcacattatattttgattgtgaagtgctgcttttgatgctgcaatggctgttttagagaaaacaattatgtacatgtttttatgataatgatgaataagacatattttgttcatgaaaaactgtacatttttcacacttaattgaatctgatatttgtcttccaatcaattagtatatttaataggatcatatttcttttctttaaaaagatgacataaaatcaatggtgcatccaaaaatcattagtatgttgggataaaggagataggacatgtaaatctccagagctttgacttgtttcatggcaagtctttgcagaatgtctatgcccaaatgtgccataaaatctaagggaaatatataacccagttttaaaaccaatagtagtggtataaaaatgttaaattcaacagacatttattgaacatcctctactcgtaagatattgcgcaatgcatcatgaggactacaatggtgaaattaaacacatcccctgccctcaaagcacttaattctgtgaggaggagtctgacaagtgggtaactgacatataagtgttatgaaaactcagagctgaggcacagggtcactaaggctacacgtgctgtacctttgtgtaaattacaaaaaaaaaaaatcccttcggggtgatgaattgcacagaaaagtgtgggtacacacacatacaccctgtggatgaattactacaagttgttccttctcctttcaaaaaagggaaagataacttagttgaatgttcagggaaaaggtggcatttgtggtatggttggtgatttccatagccaaacatggaagagggggagacttcctcaaagagagaacagaaaagaaaaggaaataacagtgttttttttctcttaaccaatcatctacttgcatgcactttatttactcatgcctaagacatgagtaaataaaaatgaacatgaactagtctaaatttcacagggcaacaagaagttgagtagaaaaacagattccctggagtcttataaaaatattttctaaatagaggtaatgtcaaactcagcaaacagagcctaaagcaaatttcttttctaaccagtttggggtttatgtgcaatcattgcaattatgcctattccaaaagatgagtatttgcaatggcaaaatggtaccatttattaaaatcttaatagccatagaactctttgcaaaaaaaaacaaatggaaacacaatccagcccctccttacgaatatctcaaagttcttccccatactctcatcctccgttaagttctagaccccagatagggaccttttagaaagcatattcacatgaaactttttttaacaactatggctggcaattgaatcacagcaaaaattgctctaatatgtcaccaaaagatactgagataagcaaaaatccctcatcctgtctggtcttcctattcccagacaggtatacctggtccggcatgtcaccacaggcaaatccaagaaaacaggaaagacgtcacagggaacactccgcagtgcgggcaccaccatgttcacgttcaccaggtgtatctccaattgagagccattgttggggtaaagaacacccaactccaaacctaacacaagggaaagaaatctcaggctgcatagaattgtcattgacacaggacagtgtgaaactgtgctaagatcctgggggtaatgtaagacattaaatttgcccaaggattaaattaatactcctcatttcctcatagatgctgtataaaggagttttctcatttatgattttatgaaagagttttctctcttcaggttcacctaaatccagaaaagaatttttcagccctcagatttactctttactctgctggggatggatatgctaagcaatggtgcagaagctcccaagtagaggactgtctttaaggaagatagccaagattctgggagatgcattgctgagcactatgctacacacttccatatcatctcatgtagaaatcccagagtcccatcccacagcctggaatgggaaagtggacacagagttgtcatggtatgctgtgctttgcttctgtgacattagcaagccagtatctagaaagacagaagttggtcagtctgttcgtctcccttcaggcccacttttacacctgtccttagaaaaggaagaaaaccaaagactcatagtctttaggattgtgggtcaatacataagaaatgtgcacttggtaaaaccccaacctaccatcaaaaatgactgtgatccacgttccccctgcaaggctaccttcttcaggttcaatatgtaaactcaggtgacgtactgtaagtaagtgaaaaaaaacattggttttgaaggtcagattcaaaccactaccttctgcaatattttaagcaatatttaacctgcctcagaatcaccagaaaggcttgattaagcacaggtggttgcaccacatccccagagtttctggttccgtaggtctggggcaggcccaagaatctacatttctaaccaggtgctgctggtgtgggaaacacatcatcagaagccccattttaaggaaaattttgacaaattcttcttatcttagacattcaaaaaccctgcactcatcaggacaattctgaatttctacttcctttggaaagagcctcaaggacatatttgggtcctaatcaaacccatactgtctctctctgctctctttcccactctttaatcaggtggccatatttccctgtaaagatcatcaatcatttccagtcctggagagaaaaaaggacttccattaggttggtgcaaaagcaattgctgttttgcattccttttaatggcaaaaccgcgattacttttgcaccaacctaatagaagctgttcctatttcaattctcctgctcaatatactgcttaatatactagttttccctcatgatcagaatgacttcccaaatgaatacaaaattatctagattcttgccttgcctgcttagagagggggtgaagcatggatcattgctggaatttccttttgtttaaaaaaaaaaaaggcagtatagaatttatatactaggctagattggattctcctgtatagatcaccagctaagcatgggccttaatctatccctccatctttgaagatgttcctggacaagtcttgatgaaggaaaggccaagttaaggaagccagcaaaaatcatgcagctgctcagtgaggtaataaacaaggaaagtgttaccgacagaattatttatagtttctttagaagaaactgtgtctagcccaggacttccctgtacagttattctcatgatgcacttcacatctgaaggtggtggggaaccacgtcacattagcacaaccatttatggcagccccagccagactagaccatcttccaaagatgattagatacttctatctaaagaagccccaaaacaaaggccataaaaagatacagaggataaccaaattcgcagagaaaattgaacagatgatttgagataatacaagcaatctaatgattatgacaagttaatctctttgggaaagtccgacagcaaaatctaaaaagaattacatcacatagcccaaaaggaattataaaagaaaggttataagttattattaaaagctctgcactacaacaataatcttcactgaccattaaaaattgaagtatatagtcataacatttcagtatataacctcagctgttaaacagaaaataaaaacaattattcaacatataatttaaacccaaaagcaaataccttaacacctgctctgaaaacagtatttttaactcaattttttgattggcaagttaaaaatgcatatatttatggtatacaaccaaaatattactttaagtttcaataatagttctcaaggtaacctattgtgttcttacctataattccttcaaaacacattctactgacctgccaaaagtagtacttcaatactcatcagagagatcagccaggcagtcattctgtccacttaaatcaatactcttaagattgctcagacattaaaagcattttcagttttgattggagcagcatagcttttgtgctttataaaaacaaaaaaagcaaaaaaaaattatcattttgtttacatacgattattttgctgttctgaaacctgggaaattaaggagatgagataaacatggccttagtgtcttcaaatggagccaccatttttccaagctcaggagaaaaggatcatctgagaaccttgcataaaatcatccccactctgccctccttgtcccaccaacttattttaagctggataaataataacctctttcattaactcattattgaacagaagctgagttttaaaaagaattctagaaattaaaattctagttcgtgatagggtgaagtctgttttgctttgccctgtgctggcgtccagctttccctcgtgctgctctccagtttgaaccctacactgcagccacacgccgttctcaccgtcactcagacaagccttccacacatcagcctctgccttggcccctgctggtcccttcctggatgccctcaactctctccgtggcctcaggagatcctggcgcaccttcgtggtgctgctcaggagcccctcctcagctgattctttcctccgccattccagtgctcaccaccttccccctgaacctctaacttccgtgctgtagagcctagaccagataatgtggcacacataggcctcttcttccagacggcacgttccttgaagagacccaggaaccagtcttctatttccacagccttcctagtgtgaaagtgtgaaggtcccacacagcgctcagtacattggagtggatgaagacatatttgaataccctaaatctgggtttacctaatctgagatgaacagctttcactctcatgcctgctctaaggaaagtgctgagctgctctccagcacctcatggcagagggcatcgacaaaatcctcttaaaaatagtgcctctgaaattttctgaaagtttgaaaattacagaattaaacacccacatgtactactaaatacacgtttaatatatatttaattatgtttatgtttattacatataaatatataaatatatttaatatatatatacatacctacatacacacacacacatacacacacacaaagtgtgtgtgtatgtgtgtgtgtgtggcagggtctcattctgtcatttgggctggagtgcagtggcatgatgtcagttcactgcaacctccatctcccaggttcaagtgattcttatgcctcagcctcctgagtagctgggattacaggtgtgcgccaccacacccggctaatttttgaattttttgtagagacaggttttcaccatgatagccagactggtcttgaactcctggcctcaagtgatctccctgcctcagcctcccaaagtgctgggattacaggcatgaaccaccacacctggccatttaatttatatttttaagaaaacactgagattagcagaagtagttacatcatttctgaaaatataaaagctacaatatactccccccctcaaaaaaaaaatctgcaaaaactttgcaataaactcaccttacgggcatgttctgattgagacagctggaaatctataatcatttctatttaattcaacactgcaaacatttattgtatgcccactacgtgctaagcactatactaaaagttgggaaaacaaacaatctatgtacctgcccccgagtcattaccagatagggtaagtgtggaggctacttggatttaagaaaggaattctagtattttcaagtggattcagcaagtgttccttttcgttgcaaaattcccaaacttttacgtctatttgaaatagaattcaacttataaatatacaactttcagaatacatctaccacatagggaaaagtacccaagcgtatttgctgcttagtccaaaagcatgagatctgacttgcttgttacacagacaaaatatactcagcacaggagagtctattttcaatctggctacgtgattttaacatttcttcttaatgcctactcccaagctcagaacaatagaaataaacattcgcacactggttttcttaaaaccctacatttggaactgcatctttttcatgtcaattataaatgtaattttttattagtctatccactaattcttcctaaaaataaactcagactctctttatttctcataactaaaatttttcaaccacagaggagagctgtgtgcatttatttagtcatgtttttgttctcctctctctctctcctctctctgctctcactccctcttcccttcttcctcccttccctctcagcttctcctttgggacatcgagggacaaagttgcaaggcactactatagatctcccatttcttccttttgttcaccagaacgttaacaagagatacaacacctagaaaacagagagcagagacttttctggatcaaacagtaccttttttttctgtttctgtctccttgtgactcaagggagaaatgatcctttctttctaagtgatcttatttctctctgtcaagaatccgtggacatgttatctggttagagctcagcctgcagccaccacgcaggtaactcactcacgttagactataactcacctaactcgtttgtgtcccagccaaatgt

SEQ ID NO: 240 - DNA, 366777 bp, Homo sapiens
  source 1..366777: mol_type = genomic DNA
tgtcattttgtacatacagcatttattacaatacttggcatacagtaaatgcccaataagtatctgttgaagaaatgagttaataaatgagtaaatgtcacattgactttatgaaggaaaagatctggcagcaaaggtagcaattttaggatagaaaggaaatgataacatgggtaagggaagtatttgagggtcaataaggctctgggggaaccaattcctcaaatcacactgtatctgtaactatttcctccatcagtgcacaagaatggcacactgttccaataatggaacactgggcacatgggagttatttatatcctactgcttaaggtcatggccaaggtctgattttgcaattcaaaaaattgcaacctccagcataaatgggttatctttaccacaccaatattcttggtaataaacttacatttatgttctttctttaccaatattattaacaataacccactattattggtatattagtattagtatattattgataatatacctatattattatattattaatataccaataataatatattaatatgccaataataataatatctcaatataattggtaaagaagagagaaataaaataaggcttctctaccatattatttcacctatcactttattccagataatttatatctagctgcaatttatctccaaagctctaattccaaagatttcaacaccaccaatttaatatctgaattgctcctctctcatatagtgggtaccccaaactcactaaaggcaaagcttaagcaaccatcctcttctttcctactcccccatatctgctactggaacttccattcccaaagatatcctgactacggacaatggtgtcactgttgacaccctctccacagtccccaaagtcaggagtaagcaaactctatttcctctcttttgtatttctttgatctgtaccatcctctccattctggctgccatcaatctcctcccagtcctcaatcaatttcttctcaatttgaacaattgaaacagtgtcttaacaagtctttccatttggtccatgctccaacccattcttcaccctgcttcctgctgcctcattaatctttcaaagttcagcttcctgcaggctcctcctctattctgaaatcttcaaagcctgctcagtggttactgaagtaaacagaagtactttagtcagacattgaaggctctccaaaaatatgtctccacccttcttttcttctcggcatgctttccacattgcatccaaatgaaaataccccacaccttgtaatatccgagctctttactcatgcccgccctcagtgtggagggtccttttctccttctgccaaaatcccactaacttggagctctcagagtacagattatacatttctaggtgcttatcttacattgctttatattacagttggttacttggattttccttcttactgaattgttatttctttgaggttcaaggttgcgtctcacttatgtctaaactccccagaaagcttatataaacgaaagtttgcacattaagaaaaagcatgggccctgaattcagatggacttgaatgcaaagcctggctttatcacttgatataaaaaagcaaaggccctaaactctgtgagcattggtttcatcatatttagaattgattaaccagaggcttattttccaagttattgtaaagacctgatccgtaaagcatataacacaatgcaggcatgcaagaggcacccagtaaatgggagctattggaatagtagtaactattaccacattgtaatatataatcaatatatattggttaaattaaactaaaattaacataataaatctttcctgccctccaggaggatataatctaattggggaaagccacatgctaatgtaattaaccattctaagtaaaatgtaacatgaatgaatggaatcagctgtaagttccaaggttatgtgaagagaaagactgacttcctctcagggtggagaagacgtcccatgaaaaaaacacaggacctctgcaaagtctcctgcaacagggaaccaccacagaaataggcctgctctgaacaataaagggtcattctcatttgttttcatttttgttttcaaattaggcatgttttaaatgagtcattaatcatgtacttacttcactaattactcatttcttttctagctaattttttattgaaaggcatcctaaaacagggagaaaagatattgtcttgaaaaagagaataaaagtctgctcagaatcacatctcagttttttctctaagaccaagtgtcagaatctgatgtgatagtctatatgatcttaaaggtgtccttttgctcttgggacctctgtgatgtcagctccaacatggaaaatacaggaaacagctaggaaagactgtagtgatgagtcccattttcaacagattccaagtgcacacatatggtcagtctaaatagctttctccttaacacaaacagagaaaaccttgttagtgctcaacctcctgcactattcattccccaacatgcgtgatcctgtttggagttgggaatgtagggaatctggcctttctaattacctgggtactgtcacacagatcaatgtcagagtatataccataagactattgactattgaagaacaattcatggtaagtaaagtaattttaagaaagctgggaaaatgaattattgaaaatttcaaagtgtgataacacaactaactccaaaacaggaagtgaaaacaagattaaaataaaaattgatggtgaaatgttattttggactagttatgtgtgggttaccaagagtgatttaagatattttctttcctctttctccatctctctcaaaaggagaaaggcgaaagaaaacatcttaaatcaccaggtctgggctttccagatgtaattccagaaagagagaaagacagagagagagtttgggtacatagaatggtaccccaaagtatggtatgatgctttggcatactgagcacttttgaattaaaataaattgaaaagccttagaaactgcctcagaaccagggactttctaagcttctcttatttctaccacctccccaacaagtgtagaaaggtatttgctctggtatctgagtgaagaaaccttcttccaaaagaaatgcaattgtcttaagatcccctttctaagaatcttatcaactaatcaggaaaaattaaccaccagagaagagactaaaaattgtcatatgcccacaaaaccttttcacctattcttctgagggcagctgcaaaagattacctgagagactgtatctgcataataagacaacctatgttcacagtgtactttctcccctcaccttcttataacttgtccaaagactattgtttgtccttaggtcccattcagtgttcaaagggagtgatttgcaaacaattatctagtctttgagaccacgtactccccctagaaatcatttactactcctctaaactgcctatagcccctcataccactctttcctataaagaaggtatttaagccataatcatctggcccttctttgaatctgatattctctatggctcccactcttacacacattaataaatttgcatgccgtttgtcctgttgatctatttattgtcagctcacctcagtagactggagccttcagaggaggaagaaaaaatctctgcactctactattactatctatctatctatccatctatctaatctatctatatcttgaaatcttggaatcactgtgtatgttagtctgaataatgaccctaagatggccatgtcctaaacatcagtatctatgaatgttatcttatatagaaaaggggactttgcagacataattaagttaaggatcttgagtgaggagtgtatcatggattatctagttggtaaatgtaatcacaagtgtccttataagaaggagtcctagggatatttgactacagtaaacgagaaggcaatacaatcacagagacagaaattaaagtgatgcagtgaccatgctaacagcaaggggtgaactagatagcaaaaaattttaatcatgcagtgaaggaagttaggacaacccctagctgtgaggttataggaagaaaagggtcaaagagaggaactactacaaatgcacctttatgccatgtggctcagatcttcttggttggagcttttagtaataaaaaagttaaagtaggtccagaaataaggagaagctgttcaaaatgagtcaggctgctggaaaacagaggggggttcctgtgatccctctgtgtccctgcagtgggaaggaccctcgccccaggctggtgaaggtgcctagctgtgtgacatgattggcatccccagtgtgggaccatgtaaaacctacgtatctggaataaggcctctggatcttttttaaacaggactgaacaattgctccttgttttgaaaaacttttctgttgctgttggtattttcatgtccaaggcaaacagagagtcatgtggatgctcagaaattgaaaccttgcccctgttttggaagagatgtgtttcagcctgtccttcaaagggatttctcaccatgcaacctattatgttcatattttatttggaaaaatggagagaaagagaagaggaaatgcaaagaagaaggaaaggaaacagaagtatgggagcaagaaagtccaagaaagaaagagaccatcgggtgcttgtgcatgactgtctttcatatggaattaatggtggtttaatggggtatgaaaggatgttttactggaaacaacgaggaacaattgtctagctcacgtttcatttcacaggtcattattgcattaagaagtaaatcgaccaagtctggtaaataacagtctgtgtattgccgagagcttcaaaccaacaattttagccatcacaaactaatatctctgtcattttaacccttgcagggttgtgctagggggctaaacaattacagtcttcacccagttctagaaggtgagcataattcattgcccttctagtcccttcttttgcaaaacccaggaggccatattttagcattgttgttttgttgatgagccagccttagccaaatgcagctctggtggccttgaaaaacaacccccattttagtgagtgctgcaggcatctttaaacacactgcttcctctgcaaaattaattgctgcaaaatgcagtgctccctcatctaagcttttgcaagctcaaactcagctatttgggtaggtcatagatgtgtctgagagatccagggtaaatgagctgcttttctttattatagaagttcacgttcatgtcaccaaacattatcaggcactggacatacaggagtttctaatgcttaaattccggttccattaactcaggggcaattggtggatgaggccaatcctggccgtattttgaagcagttgtgtagtaaataaacacatcaaagagagtttattgtaaacaatcatacttaaaatacatatggtaaaataaagtgcatattaaaataaaattttcttgcttcaacttgggacaaaaatgtcaaagacaaaccaggctatactggccccgcaggaactggtcttaatcacctcttttctgccatcctatccatccttttacatctcttggtataccccacatgaactgacctctgttccctctaagttcccattaccgcttcatccccctccagcttcctgggccagccccatatgaactgtcaacatttcctcataatttttcaatcaaaaactgatgtttatcctacagagtggatatggaattctccacacttccacagtacctctaaaatgtggtaagtaaggtctaatttctttcttgaaagagaaaaaatcttgcagagatggcatcagtattccaatgtcttactttttttatttcaactaagactaaggtcttacaaataactatggtgtgctgaataatagcctccctaggatgcttatgccctaatcctgattatgtgaatatggcaagggactttgaagatattattaagtgtatagatcttaaagtaggaagactatcctggactataaaccttagaagcagagaactttctctggctagaattagagagttgtagtaaaggagaaggcgggagagattcaaagcatgagaggcacacaattagctattgctgattttgaagatgaagacagccgcaagtcagggaatgcaggcagccctagaagttgagcatgaagcctggcctacagtgaacaaggacacagcaaccataactgagcagcttagcagctgagcctcaaactgcattttaaacttttttttcttattttccttttcctcttttctcttccagtctcgggataaaattttgagacaaactgcatatgttactgatggaaggtatccgagttaccagcagtaaatctgtgtgggtccgcagcaacctcaatttctgcctcctcagatgaaagaacttgacagagggatataaggcagaaaaagagaccgagacaagtttcagagcaggtgaggaagtatattttaaaaggctttggaacaggagagaaaggaaagtacgcttgatagagatccaagtgggtgacttgaagaacaagtgtggtgtttcactgttaactgtgatactaggactttacagggtggcccccttctggcgtctttaaaccccttctcatgattcttcccttagggtggtctgcccacatatgcagtgccctccttacccttgggaggtgagcatgcacagtgtgttaaggaaactgtatgcatgcccatctgaggctttcttccctttgctgctggtgtgcccctggaaaggcaaactctgccatttttgtctcttagtgcatatgcccaggaagttgcttcttcctggcgtctccattcaattaacacttcagtgcaacaggtgtggcccatcaggaaatggcctcttcctggcaccatctgccaatctgtcacttttagggaggcaatgtgataattgccaaaccatcactcaacattcctagtgggtaggggagagccctcttctgccctactctatgcctgtctaacaacctataacacatctatgtaacctctcatattaaaatacagcctcagtatgtgctgtgaatctcaattccttttccttctccatacaatactcccatgccttatgcacatttatttacctaaatgcttgtcaagcacgcaccatgctttcttatctggtcatatatttccttatatactttaggagtcagatcctgatagtgacaaggcacctctggaattctctctctaacaaaagattgcttaaagatggaacccactcccagatgatgagtgactacaaaattgactgaaagtaatttataacctggcagggtctacgatggcagcatcccctttgccaaataggacaactgttcaagaggggccactggagcaagtcacgctaccttatacctctcagcccccacacttcttctgcattccaaatctttcctttaaaaacctctgtggaattgaataggggaactgaagagtggaattgctttctactcttcccctgctagcatggataataaaccaattttgcttccttttatcacaacttattattttgacttcttttcataagcagtgagcagccggactctttggccggttacacgaccacagtcctacaactacatggaactgaatctggccaagaacctgagtgagactgaaggtgaaatcatctccagaaactccagaaagaaacacaatcctgccattacctgaattttggccatcagagatctgaagcagagaaaatagccaagttcaccagacttctgacctacaaaactgtgagataatacttaggtgttgtttgaagccactacattgttaataatttgttatagcagcaatagaaaacttgtacaaaaaccaggatgtcatgctcaaatgttcatcaccattccaaccaggatcatgataagtggtggcagtggtggcaatggaatggaatagtcaagttatttagtgcttatcctatgacaggcctggggccaagttttttatatgcattttgtctacaaaattataaagctctaagatttcctttgtctgtaacgtgttcaaacagaaagacagtatatagcctacagatatggataggctggtttccacatgggcagtgcccaagaaaggttgcatcctaccaatatcacccaaaagggaagagattattattcatagccatattaaaaaatggcttcaactcccttccttcatggcaatgactttcaagaacttacattcagtttttattaatatttctcctgtgaggaagctaatcaaattgaaattcagtcatactggaagtccttaattctgtagtagaaagattggcttctaggtctaggaaaatttcttttctttggtgttcttttccttgacacactttacataataaccaactcatgtttcaagattctagttttccatataaatgagttatactatcattattcttactataaaaactaaattatacatacacatttttttaatggcaaccttctagtttttccctctgagtagtagtgctgaagatcaagatagcagaggggtaagaggcatgatatattttctttttcattttctgttttactgttttatttattcattcaacaaaaatctctaggataatgtcttaaaagtgaagttgctaagtcagaagtacagagctttaggtggtagccagatgacaaaaagctaagaaaagtgatatttgagaacgaagtttgagaactctttctccacattttccccaacactgcaaattatcacactttttaattattgcaaatatgattgggaaaataataataattatagtagcagtggtcattattgccttagaagtggtggaaatctttattaggtttatctttttaatccttataataatcatttgagtacataatattaatatctccaagtcctaaatttaaaaactgaggcataaaggagatgagcaacttgcttacaattgcacatctggttagtggacacaatccaagcagctggactcagtgcaagaactcttaacctgtgctttgattgtgagaaaactttggctttttgtatgtttattgatatttgtttcatttctctgtaaaatgtttcttggaattctttgcaaattttttcagttggtttgttcctttttgttcttaaatattagtaagttgtttttacattgatgaaattagccctttgctagatgagttgcaaatttatttctagttttttagttttgcttttaatattctttaagaagttttaattcttttatattcaaatttttaaatctacccacgtattttctagattttgattcatgcaaagaagtatccctgtaactctaaataacgtcatcaatattttctagtaattccatggggttttccatctttaatccatttaaaatttatttttgtaaagaaaaagataaaaatttctgaattgttttttctccctacatgatgagtcaaatggctcaacgttgctatttgaatgatttctattttcccataatttaaaatgctatttttgttataaactaaattgtcaaatgcatctgaatctatttccgacttttagaagtttattccatcaacatatttatttctagaatatttttaatgaatgcttccaattgtcagaaactaagattactttttacatctcatgaaaatgtaaatacataaagaaaaaactgtaaaccagacaagcgaatttttcagacccataatattgagatgagaatttgcttagtacttatttatgagctggtttggtatctattggcaaggcacaagcattttatttattggagggactgctcaagtattcccttccattaaaatgtgcatatatgcatacacatgaaaatataaaaataatgaaactgaaaatagacaaacattcatccattcatcttaggcataaaataagctcaggtttgagattctaccttctaaatttttgagaggttgaagggagggaagagggtctcactctgtcacccacgctggagtgcagtggcataatcatggctcacttcagccttgacctctcaggctcaggtgatcctcttacctcagcctcccaagtagctggtattataggtgtgcaccaccacacctggctaatactttttgttaaatttttcaatactattgtactgaaaggattaaagcagcaacgcagggttactccattattaaaacttgaagactaggaacacagcttactagtcaatgaagtccttgaaataatatgggaaaaaaagagaaaaaagaaataaactaaaataaaaagaaatagaaaatacagagccagtttattattatggcaaaaaaatcaagtaatttcatttacagataggtattcaaaaatagctcctcttgtggaacactgatattactgcttttcaaacatacaataaaacagagaaatgtgaatagatttctcataaaggattgttaacttgagtagtaaaattctcagtctcagaaaatcttgatgctttggttggaggcttgagtatttaaataatacctcctgcaaatggcaggtaatccaagtctagacaagctttgttttttaattgactgaattatatgcccaggatcaattaggtgctctctagattggtttctaattctgtgattcatttctaatcctaggaacccaggctacatctgatgaccactgacttataaaagggtaatttaccagggataaatagagtctactacatggcttaaaaaatcaattctctttaatgtgtatccctcagaacaaaggaagaaaaatatccatatgatgaatgcagctacatgtagctatttagtctttgaaatgtgactagtgcacccaaggagctaagcttcaaattatgtataattttaattaattataatttaaaatgtaaaactgataacaattattggaaaatgtttaggtatattttaaacaatgtttatatgtgattctactttttcagttgcaaagtttataaaatataggcaaagatcaaatacttttgataaaaacactttataaattgacatggcataacagtaaaaagcacaacagattttaaacacatagtataagaaacataatgcaaaatatctcaactacactgattacatattaaaatgatgatttttaaatatattgagctgtttctttttactgcttttagcctggatgctaagatactaagtcacactggtgcattatatttcttttgaacaatactgttctggatggttaatattcagttcttattcctagatttagaaaaaaatcactgaaaactgaagatcatcaaaaatatgccagtccttcataaaaatatcaaaaatttgtggatcaaaaaactctatcaacagagtgaaaaggaaacctgaagtatggggggaaatatttgcaaatcatatgtctagtaaaggattaatatccacaacataaaccacaactcctaagattcaacaataacaaaaaaacccaaacagcccaattcaaaaattaatatgggacttgaatagacatttctccaaaaaagatattcaaattaacaatgactccatgaaaagatgttcaacactactaatcacttgggaaatgcaaatcaaaattacaacgacatatcacctcacacccattaaaatggttactatcaaagtagaaaatttcaagtgtcaacaaggatgtggagaaaccattgtgtactgttggtgggaatgtaaaatggtacagttattgtgggaaacaacattatggttccacaaaaggttgaaaatagaactatcacatgaccttgctatttcacttctggatctatacccaatagaattgaaagtagagtctctaagagatatttgtataccatattcatagtagcattatttacaatagctaaaacatggaagcattccaggtgtccatgggtggatgaatggataagcaaaatgtggtaagttcatgcaatggaatgaaattccataatatgctacaacatggatgaaccctgagaacattatgctaaaagaaataagccagtaccaaaaggtattgtatgattctacttatatgaggtacttaagggtagtcaaaatcatagacccagagagtggaatgttggttttcaggaacacggggtagggaagaatgggaagttactgtttaatgacattagagtttcagttttaagagttgaaaagacttatggagaagtatggtagtgatggttgcacaatactatgaatgtatttaataccactgaactgtacacttaaaaatggttaagatgggccaggcacagtgactcacacctgtaatcccagtactttgggagaacgagatgggcggatcacaaggtcaggagacctagatcatcctggctaacacagtgaaaccctgtctctactaaaaatacaaaaaattagccgggcgtggtggtgggagcctgtagtcccagctactgaggctgaggcaggagaatggtgtgaacccaggaggcggagcttgcagtgagctgagatcacaccactgcactccagcctgaggacagagggagactccctctcaaaaaaaaaaaaaaatggttaagatggtaaattttatattatatgtattttaccacaataaaaacataagccagtctaaaaagtgaagaactaaaaaaatgtcatatattggctgatagaaggaatttagaattcctatgcttgaaaaagtcttatttggcttattataaaatcattgtcttactgtctttgaatatgtaaaatgctgtaatacagaaagacttatatgaaacctggaaagacttatactctgtcatgccaaaaggcaaactaggtcactgggtagaagtcatagaaggaagagcctaacaataacaagttattcaaaatataatataggcagccttaaaagggtgtgaactcccacttcctgggaaaatgaaaggtaaagggcacgtatgcatgtgaagtgaagctgattgatcttcaagggaccatccaaatcaaaggcactacaatcttgtcatttctttccaagtagcatgtattcctgtagactaatagattaacatgaggcaatatttcccagaatgtgttctgaagtacactagttccaagggaccctaatgtgtagtatgaacaggtattctctagtcaaaaagcttgggaaacaccgggtaacacaaaattaaacagtgtttttaaaaatttaattgcagaacttatcagaatcttcagtattttaatacacatggtggtctccaaaataggaatagtcagagttttcaaaatttatttggccatgtaccacattttttacaatctcctgaaattagaaaatgggggaatattctttgaaaatgctaaaacaaattatgcattaattaaatctataaaatttactttgtggaagagttgactggcaaactaaacttaaattcttgactttcttattcacatttgttccctcattcagcaaacattaacaaagcctatattatgttccataaattgtactagaaattcaaagacatttaccttgaagtcactcacagtctggtaagaaagcagacttgtaaaatgatggcggtaacccacgagaggggctgtaatggagctgagcaacgggtgaaggagagtcacaaaggtcctccatattcctgagttctgcatcagtggatttgatcaaaaatccgctgatcagatcaaaaactgcagatcaaaaatatgtggaggaaaaaaaaaaactctacaaagttccaaacagaagtttcacttgattttgattttgccacctgacgagtactatgttgaatccacacaaacgaagtgatgtgttagccatcttattaggtattataagtaatcgacacacgatttaaagtgtacaggagaatgtatgtagattagatgcaaacactacacctttttaatataagacttgagcatctgtggattttggtatctgtaggggtcctagaaccaatgccacatggatgtttaggaatagctgtatatatattatgtatgaagaagaggaactaaatgagtttttttgtggttgttatagcatcgcccttcaaaaatgttaaagtagtcgacagttacttgttaaactctaaaaatctatttgctaccaagtaaagtaaaaatatgtgaatgatccagttaaatatatctctgtatagagtcctaccagatgattcagaccacacaatgataattatccagaagtggttatgaactctggctttggagtcagacaaatatagatttaaatcttggttctgcacattctaactgtgggactgtgaaaaattagttaacttctccaaacctctattttcccaaatgtgaaggggtataacgatcccttcatgttaaggttgttgtaaggataaatgagagtatttataaactatttagcataatgcctggcacatggaatgcactagataatggcaattattattattgctagtttgtttggataattgctagaataattgtacaatctcagttttgtttgttctgtgtggacagagctttgtatgcgatgaaagctgacagatctaaaacagttaacactgaagaatataaagaaagaaggagaaaacttggatagagggtactgggtagtatagcatagtcttaaaaacacagttcggggctgggcatggtgactcatgcccataattgcagcactttgggaggccaaggtaagaggatcgcttgagaccaggagttcaagaccagcctggccaatatagtgagacctcatctctacgaaaaattttttttaaaaaaaactagccaggtgtggtgacatgtgcctgtagtcacagctacttggaaggctgaggtgggaggatcacttgagcccaggagttgaaggttgtagtgagctatgattgtaccactgcactctggcctgggcgacagagtgagaccttgtttctaaaaataaaaaataaaaataaaaacacagttcaatctgaaccttgttaattagctttaggacttggacaatttacctaatgtctacatcagttcccacacctataaaatggaggcaacaggactatctcttagagtagaacccgttgatggcattaaatgaggtaactcattgaaaggtcacagcacagagccagaaatatggtggacactcagcaagtgttagatgctgttattgttaatggaagatttgaggagcaagacaatcacaataataacatgtctagattgaggaaaggaaaaggaaattgtccccatagatcacatgcctgttcatatcatcttttatagatcacacatgaaaatcattccaactcacagcatggactactttgaaatgtaatcaaatattgttatggcattcactgcctggagaccaggcaagtcatgagggagtgacaaaataaggtgaaggaaaggtactctttgggtctgaacgatgtaccactagaagccgtatccccccctgcttgggattaaaatcccttgcagctgcgaatcccaaagagtctaatattttctgagactccactgtgcctttatattttaataccatgacatctggaatcctaaaagtctaatgtttaaccataaatatctgctgaaattaaagagctatataccaagcttcaatctttggggcctgtaattgcttgggaaaagagaatggtattttcccctctagctagaagaaaaagacctctgcaagcacagatattggcagacaaattttctaaccgtttcctctctccattctgtcctctcattttctccctccctctccaatctcccattttataataccatcttgctgtcattctcaggataaatgggaaaaaagagaagcctagaaaccttaaagaaaagacacatttcaaggtctagcaacaaaaagttgagaaactgcaagccactctctgttaagtagctgagcagacgtcaccacaatacctgagctttccccattattcagttagaaaccacttcatcactcagtgggctgacagtcaaatgccagctttattttcttttttttatcaacctaatcttttatttttgatttgaggccagtcacttttaaggtctccacagtggtttataactttctttcttgagaagtgtccaagaagtaacacaatttgaaaaatgttccctactgtctcatggtaaagaatgggaaactcacctgccctgaaggtgtatgtggtcagaaatcttggtcagaccacagtactttgctggaaataatgccaaggaaagtgtgggaaaagcttatcgtgagtttatatttttaatataactattctatgtggcatttaaaacatacacttagtatcaaacccatttttatccactgatatattatgaaagtgacattttgaggtcagtcacctcacttctaggaaaaatgatccatttaaaaagaggtttaatatgttgtttttattcaaataattaagattgtaaatattcctgaatctttttagctaatgttcttttctcttgtggaaatatattcagtgtgttcataagcaagtatgtttatatctgttggtatttggcacagagagctaattcttgattattcatgaaaatttgaaactatccactcactaaattaaaaatattgtcttcttaatatcttgtttatttacttcaaaaggaacatataactctatagtgatgattctcaagcctaacacagcagaatcacttattgtttgtgtgtgtgtgagtgtgtgtgtgtgtgtgtgtgtgtttaactcaaaggtctggactttacacacatctattgattcaaaatctccctacatgccaatgaatgtttaatgtcctagatgatcctaatgataagtcagttttagtagctagtgtcctgaccacatcataaaaaaatattggcaggagaatgaggggggtttgttttgttttaaaattttcagtctattgaagagtaataatttaaaaaaatacaaataatcagacaaattagatatacaaactataagccccacgtttacttattagactcaacagacataaaattactctgccaaattgctgtgtttctaagtggtaaatttctgtgaatacctcactgtagacaggtagccgatagtttgtgggccagcacgcgtggagcagctacctccaagccccacctgctccccttccacctgcacagcttcctggctgcactgcccgcctccagacagctagcgcactccaacacagctagcacaatcttttcagggagcaaggaaaatcctactgccacctttcttaaaatctcccaaaatatatagaaataggaaataaaactgtggttaacagagacaggggtttgggagtgagaggaaatgaggggatgttggtcaaaggacacagagttgcagatatgtaaggatatgtaaggcgaataagtccagaggtgtaattcacaacgtgaggaccctaggttaataatactgtgttgtagtcacgatttttgctaatactatgaattataggtgctcttgtcacaaaaagtaggggtggttaaccatgtgagatgatggatatgttcatttgcttcactatagtagtcattttactatgtgtaagagtatcaaaacatcatgctgtacatctgaaatgtacactaaataaataaattgaaataaaatccaaaccttttactctggccaagaaagaggctggctcctgtctatctgcaactgcttcttctctcaaaaactgcacacagtggtctcctttccacccacctctcacacatgctgaggcccttttggatctcagagtccctgccctggctgctccctctgcctggaagtctcctccctctgctcagggcaggcactcctcactccccattcaggtctcatttgaaatgcaactatttcaaatagcaattcgcctgcacacaagacacacacacacacagacaactcaaactacctttctagcccaaaacactattgtattttttccatccttctcatctctcctggaatgtgtgtgtgtgtgtgtatgtactttatatatatatattttttattttatatatacgtattttatatattttttatatattttaatatgtattttatatatatttatatatttttttacatatatataaaatacatacatacacacatataaaatatactcatgttatatacatacacatacacatatatatgtgtgcatgtgtatgtacatgtattatatatataatatatataattgttttagagacaggtctcactctgtcaaccaggctggagtgcagtggcgtcatcttggctcactgtaacccccgcctcccgggttcaagcgattttcatccctcagcctcctgagtagctgggatcacaggcatgtgccatcatacctggctaatttttctatttttagtagagacggattttcatcacattggccatgctggtctccaactcccaactttgggtgatctgcctgcctcagcctcccaaagtgctaggattataggcatgagccacagatcccagaatattttttatttggaattttgtttatgtacctctggaatttttatttgtttatgtacctaaccctactggaacataagtttgatggcagcagaaatgttgttttgctcattgctatagtttccatgcttagagacgctctggtagacagaaagtaggcaaaatacacttgccaaatgaatgaaaatgccaatttcagcgtgtagcataaaaaaggtgctcatgcaatgctagttttcattttacctcccttccacttttttttttgtcatggctgagaaattgttaaattctgttgaaactgaagctctgatttctttctgctgcctcctgacactgctggtgccccacatgtgtgaaccggggtgtgaggttatgccatccatttgtagtctgggacagacggaaactgagtttggagccagaatggaaagctttggtatctgcctaattctacctgaatgggacattaatttcaatgctttgttcttctaaatgattttgaatgttcagatcatcagatgcctccataatcaaaagaaatcctttcgagaataaaatgtaaatggttctcagaagatcacctgcttggcatgagctgtcttgctctctactgttatacatttttccaagttggctgcacatgcaaacttacagataagtataaatcaaaattagcagctctcttctcccctggctacacatcctgcattacacagatagcaaaacccactggcagagtgttcctcagagctgatccacatggatggtttttgctcctaatatgacaatatgctgggacctgtggatatctgtctgggtgagtagtttttgtacgaacttatatgtgcaaataaaatctgttattttccaaattaaaaataaacctcaaaggcaatggattccaaatgacttggagagatatgtttaaaaaaatatggaaaggatataagggtctgttaaactcaatgacatttggaataaatataaaattccagtggtctccatcttcaccttagctgcattgctttctctgatttactgaagatgataatagattcttgtcttgaactgaaaaaatacaaaatagtcattaattatcctaagattaaatctgtgcttttttcatccaacagactgtggacagtaactgcaaagtagctaagagaaaatggtttaataatgaaaagaaatttgcattaaggaagaagggatttactcatactttggaagtcaaagaaaaatactgcaatcctgtcagcacccggaaggcaccatttactatgtgctgtctctttcattgcaagaggacacagattgtatttttagtgcagtaaacagcagattccactgtgggaatccttgcagttggtacctatagcaacctcatttaaaatgttataaagctctaaaacatcaggggtttaggcaatcagtcatatatacctccatacagacattcagccactcacacacatacatgcttgtccacacactgatagtaaatcgtgtgtaatatgatattactcatggagttttaccattgaatcatgtttgacagccatggtaaagaactgagaaaaagcaaatattctaccattgcaaccagcagcaagaacatatttgtgcctaaatagcatattacaccatctggtaagcaaccacctaaaatgaacactcttatgattaaacatggagaatctgactgacattttagagtttctatttgtaagggatgcttttgatgccacacccatgtatttttggcactcaccttcatacaccaaaggctgctaccacaaaacctatgacttccttctgaaaaagctttttttcttttgataattttggtatcaatgtttttctcttttttttttccttctgagagtttttggtggcctcaaggaagagcacagttagcctgtgttcagagaaagccaaagggctggagagttaatgtccccaaagcatcccccaaagtcctgacagaaaagaaaggtaagctccaagacaggggagccaggatttgaaatattaacacatgagcttccctgtggcttggctgggataatttggggtgctgttcccatggtctcccgcagttccctatcagacttgagcgccagcttccacagtggtaaccagtttgataacacttcccttattggccttatttcttttcctaggatacttcctcattttcctactggtgttttataggatcgccccccattaaactacttggattctaagccttgtatcagggtctgcttctgggacaacccaaactaagacactatcttcagtctttattcccttctgttaggataaaatataattttcatcaaatactctggaacatacatcccttatggattccaaagaaatgggatcctcaccaaaagctcaagtccagaaaagtcccacaattaggcatgtgcttattttaacatatcagaatgttttccccatagcataaatacctgtaatggtggaataattcttaaaaccaatagaaaacttactatagaacaccatttgagtagatctaggggtaaataggagggtaaccccttatcttttcttcttttgctactttctttttagtgctacccacatattttctcagtataaatgtgtccctgaatttcattcttctgtgcaaaaaatatatttgctggttctattcaacaaatgcaaccaacacattaaaacgaacatttattcagcatttccatgcgcttggcactgactttaaaaccaatactgtagtccttacagcttttcactctattccagagataagccttcaacatatggaaaaacataaaataaatgttaaaaagtataaatattcaagcatgaaattttatggtaattaaaagaatcatatgtagaaacagctccaaatgtcaaatgctgtactgtagcagtagttcaggtgaaagaaaggtgaaaacaagtaaaaagatacatagaactgtctgcattttaggctttcatattacagataaattcttaaaccaatgacctgaaggcctcagttcattctgcatgctcttggatgacgtgtaacagcaaactcttctggctggttacttataatccattcatttgatcagtcaaccaaaatttattgagtaacccccaaatacacatcagtgaacaacaaaaaaaaaatcctgccctcatgaagtttgtgttctaaaaaggataaacagtacattaacataagcaattacatttataatataatgttaagtaccacgactctaacaaacaataaagcaagcacagtagagctacagaaaaatgatctcatgattattttagatagggtggtcaaggatggcttctctgagggtaccttatttgaacagcgggaactagctcccaaagaagtgagaataaaatattccaggaagaggaaaaagccagcacaaacgccctgatgtagtgatacacataccatgttaaacgaaaaataagagaccaggataagtaagtaaaaggcgtgtcacaagagaggaggtgagagagtgggcaggaaccaggggctacaagacttacaggcttgtagctgggacttcattctgaatgggtggaaagctgaaaatatccctctggccatgtgtgaagaatagactagagactacaaaagtagaagaaagaagaccagcaaggaggctattccctcatctagtgagagacaatggtggctagtagtaaagggaatggtgagggtggtagtagtggaggaaatgagaagtttgagaatttgggttaggaaaaagaaaaataaaagatgactcccaggttttttacttaaatagcctaatgaatggtggcaccaattactgaggtagggacagctaggcaagaagcaggttgtagattggggaagagatcaagaatctttttgaggcatattgagtctgagatgtctactatctttccaagtaaagtcagttggctatactagaccaaatttcagggtcgagtctaggctgaggatataaattggaagtcatcagcatttgatggtatttcagtcttggtcctggggagcaaaattagagaaagaaggaaaaaggtctcaggacatagtcctgtgaaagtcacacattcaaaaatttaaaaggacaagggagaccagaaaagaaatctaaaaagaatcaactaatgagatagggagaaaacagaaaaacttctttacatttgaccggagcaggttccagctgaacacaaatgagaattcagagtcagcttgttagtggaaataaaaagacaatgatctctccaggggtccagccataaaaattgacataaaagggtgctttgtttgcataagcaagaagaggaagaagtttggagcacagccttgtttgggggagagttggagaatggagaaaagggagacaaaacacatgacatctaccctaccattgagagagcgctttaagtcctgacagaaaagaaaggtaagcttaaagaaaaaggagctggttccatggcagaccagtatgaaacactgagcatgatggctgcttcaggcccaagtgcccaagctgggcgagaactgtcctcccagctgtgcactaagttgggcattgagaatctgcacttttgacatggacacaggcaatctcatagagggcacagcagtaaagttgtgagatcacataatgactcagcattcctgtaatacaggtgaattggcagcagattagcacagactccaactctagaatttaggtcttcaccagtacatttcattctcagtgagcacagcaaaaccagctccttcacaagcacccttgcctctaccacaggcattgcattcagatatagcttacctgcgttgaagaaggatgcagtccattctgcctctgttttaggaaatacagaaactggtggaggcagacccagggctctcccatccagatccttgaagagatattttcttggacttgcacagtctaattcaggacagactacttttcctaaatctttcctgtgaagacagtcaaaaagcaactctttcatttcatgataagcagcaagaagaaaatatacattggtagtgctaatgttgtttaaaataaattcaacagatttttattattgacaatgtgttacatagatataaaataaaactctttatgaaataatttatttcccaattatatggtcaagaagaaagacattcttactaaccaaatattttggatatcctaatatgtaatctttatatagattgctgattttttaagaagcaagatacaataaagtgttcctctcataacaactgaacataatataattatttttaggaatttcaggggtttgcagtattttagaattattataaatatcaattatatttatgctatatgcaaagaaaaatagatattctcattcaacaaatatctattgaaaacctacaaaagacaggctgggtaacatgatggtaataaagccaaacatggcactgcactttcagaatttagagtcaagtgggctatataaacaattaatagataattataatgttgacttacagagaacttattttatttcccctaatctaatgctttgaaataccattagtaataatattaaatatttattgtataccaacaatgtattgagtattatcagcacaaagattcagctgttaatatcacatagtactatgatttgaatgatggtcctttcaaatttcatgttgaaacttaatccttaatgaaacagtattaagaagtgtggcctttgggaagtgataaagctatgaggattcaattctcatgaataagatagtacccttataaaagggcttgaggatgaagagagtactctcttgcccttccatttcttctcctatgtgagaacacagcgtttctcccctctggaagatgcacgaacaaggcaccatcttggaaggagggagaaaccttcaccagacgcctattatgccagtgtttgatcttggactccccagcctccagaactataagaaataaatttatgtccaggtgcagtggttcagcctgtaatcccaaaactttgggaggctgaggcgggaggatcacttgagctcaggaggtcaaggctgcagttagccatgattgtgccactgcacttcaacctgggtgacacagtgagaccccatctccaaaaataaaataaataaatttctgttcttcataaattatccagtctgtggtactttgttatagcagcacaaacagactaagacatgtaacttaacagctatatcagcccgggataagacatgaacataaggaaaattggatagtaaattttaaaaagtgacaaaacaacacaaattgcctacctactcatgtttaggtacctaatcatgattcagggataggcatcaaaaagagactcgtgttaagccaaacacatgaatgttctaattagggtggcttctttagttttttgctttgtttttttttcttccaataaaggagtttgccccagtgttgtgggaaagaaaaagtaattcattcttcctgtttctaactttctactctctttcatggcataaaaaaatcctatctaattttcacatatttgaatgaaactcttagatcatatgtcagaaaacagtatttacacctggtctgaaataccaatatctgctagacctcatcgttcagttcagagattcctgtcagcagacacaatctccttctatctactagttcctgcacaaaaggctcccaaggtctccttctgaagaccactgacactttactccaatgaagaatgaagaattagagtcaatttattaccagcaagtttgaaaacatcccaaagaagtctctctaattaagacaaaacaataaaacaatatcaataaaacttgcacttcattacttctgcctctttcatcagctaaagaaaatcacatggctgagtccagattcaagggggagggaaatagcccctgcctctttagtgagagatattttaaaaatcatatatcacaaggcgtgaatataggaggggtaaagaattggtcattaagttaatgtaccttaccattctaagattcatttctatttctttgatgattttattcctttcaaaaaacatgtttagggtttgaagaattgccaagtacttcataaatatggcttattataaatactaaaaattatacctgggttgtaatgaaggaaagtagaacttgtttttatcttttatctttagcatcctggtcctctctgctgttattgggtgcataattccactgttctctgcatttggtagaatgcagacatccaggtcatcgctatagcaactcttcacaaaactagaaaaggtaacatctgaaattttaaaaatatgtatcataatattatatcatataaaccaccagccacaaatatcgaatatacaactaaatattgttataataatgtataccctaagttagttaaagctatccaggatagccttaggagtttacatacatcttgatataaaatatcagtagttcttcaatacatggacattgcatgcaacagagaagagtatttcaatacgttaaacctttaagagcaatatggcttttcatttgaggcttaatcaaaatccattcattttacagaaagacaaacccactgccagataaactaagtaacaggggagagactacaatggtggtacaagagatctaatagaagatgaactgcaccagtcgtgtcacaactttgattttaaccctcgttgctcaaccatctactaagcaacttcagatgagacacaacttctacatttcaatttcctcacttgtataataggaaaaataacacctaaccaagagagttcttatgtaatcaagttaaataattgctgtgttagccgggagtggtggcttatgcctgtaatcccaacactttgggaggctgagatgggaggactgcttgaggccaggagtttgagaccagcctggtcaagatagcaagatcccatctcattatattcaaattttttaaattttattaaaaaataatagttgttgtagaaagctcttcaatatgtataaagcagtgacttttgtaagaaattataaactaccattgtggctatcaatactcagcaggttggacagcaagcactagaccacaatgtacctttttgttgataaaatttcagaatgccattaaaaattttatgcatggatgtatgaaatggcactgcctagataaaataaaacatcctaccttgaagtttcatgattcctgaaattgaatgatcattcctcactttgtgccatggctcctgaggccactgatttggttctgaggtgaatacaggccacagaataccaattcgacctcctcttggattggagggagctctatctgttgatgtcaagttggctgagtgcggcttcactttgtcctgaatgcagtcaaaagaagagctggtggccacaatgactgaattcctaagcacaatctgcacttttttgacggaattttgtggagcagaaaatacatacactactgccaaaagaccaatagtattgtctaccagagtaatgttctctatctccacgctgttctctacatgtaacatggcaccatagtcaaagttcttgaaagccaagaagccagagattctggtacagttgtcaagtccactttccttatagagatgaaggccatgaagacttgaatgcgccacattgtcagaccaaagcagttcacaagaggagcacttgtggcctcggatgtgaaagccaagtctctctgatcctgccacaacgttgccatggaggttgatgtcctttacctggttcactttgattcccgccacccaaatggtggaccacgctggctgtgtcatcagaaccacaaggttattagtgacagtataggcctgaccctctaaatctatgccatggccagctgtgccaaacacaatattgtcatttaaaagtactccatgactggcagctgcatgaatgcccccgccacagctctggtgcagagtagatgatatgatccaggatcctgctgacacattactgaattcaacagatgagtacaatggtgacccgaagttctgaatttccacattaagaagttgaaggacacctataaacaaatgcatgtcatcaggtactttcctcttccccacaaaaggctgaagaatggcccattttggggcattaagatatgaacatttttaatgaaaatgtaagtttattctcaacaccaacattatatttcacaccatagattctcaactaaaaatgtaggaatcattacaagtatcacattaatgcctgaattgcatgtgcagtctgaagagtctggtgacaggacagggaaagatgagaggagaaataggaaagaggcaaactttggggatgggcatggccaagtttaacgattctgtgtatttgtcgggggccgggtcaaagaactgggtaagaatagattctgggtttctggcccttcacctcaaagtcaagtctccctctcagtgtctcagtgacaccacgtgaaaggccacagccattcccaagaagacactgcacaaatgaatattaagcatttctgaagaagagtatgagtgcgaaatttccttctgctcagttgatgtccagaagcctgatattccatacatgcttctgattaaaacatggtaggagcaataacatgcttttaaaatcactttaaagattctgtaaaatgttttctatatttttatcctgactacactttattcactgtttcatttttataagattttctatatcttttatgtgaggagaaaatagtgaattatttactctcatttgtagttttatttgtactgttttaaatagatattgttaaaacacactataaaatacacccagtaagttgatttaaaaatacaatgattcagcatacatacttttggtaaaattaataataacatgattatagatgaattaatatgcaataataatgaggtgaattaaatactttaactctcacataacactcattatttgcagacaccgttctaattcttattcatttatttattcatactcctaattttcaaaaaaatcctatgaggtaggtacaattattatccccattttacagataaggaaattgaggcagagaagagtgaactaacaaactaggacttaaacttaggcatatggatgagaagccgcactattaaccccatgcaggcatcctggaaagacagaaagactttgtggtacaaaagtagcatctctgcattatgattcagataactgccctatagctatgagccaataattagttgtgtgtcctttgctaggtaggtcacaactttggctccttttatttcatttttaaggtactgactaaagtaaactataaagttatttatctcattaaaaataaaggaagcaatacatttgaagtttctgtttcactgtttcaataatagtattaatagtatttaagtttcaaaggcagtacagcctaaacccctcatttctccactaccttttcagaaatgagaaactagaacccttgcaaatcggctgccatgaagaagcaagtccttttgagaaagacaggctaagtaaaggaacctatacgtctacttggggccaggcaacaggattccgaagtatctaaatttctcaatgggtgctattgaggaggcattcgtagatggtgtggacatattcacagaacaataaaacatccaaaagctatttcttgggcaatatccctcaccaatagcacatagctgaaagagctggcaaacctgcttcgtagaactttggcacaaagaacaccaaatgcaagcataagtccataaataaatagcttatttttagcatttaatgtgattttagaatctctgtcaaggcaacatgtcagtattattgttatttcctaggtttcttataaatgatattacaagggagataaataaagagatgtgtagggcacggcatgagggaagggcatgcagctcccattccctccccgggtgcgccaccttagtctaggaagctccacatgttcggctatccagaagctctcaggattattttaattatcagtttttttaatgtcttatgcttccatggatttgattcatagttttaaactgtacaaggtctttttactgctgtgcacattaaccaatgactgaaaattaatcaattagtaaagacttaaaatgtcttgagcattaaataaagaattaagcaattttttttgagatggagtttcactctgttacccacactggaatgcagtggcatgatctcagctcactgcaacctccatctccagggtgcaagtgatcctaccacctcagcctcccaagtagctgggactacaggtgcatgccaccatgcttggctaatttttatatttttagtagaggcagggtttcaccatgttggccaagctggtatcgaactcctgacctcaagtgacctgcccacttcagcctcccaaagtgctaggattaaaggcatgagccacagtgcccagcctgaatgaagcaattattttattcacaactattttcctatttttccttttgaaaatcactactgaaaaatatttcagcaagttaagtacaacttgctgggtattattcaggaagagaagaatgatggagccctccaatataaaagtaggactcaaaagtcttggcctgcttttctggtctataacaaatcagtacccatatctgccatccctgacctacacctgcagatcccttcttattcaggccctggactatgttatagaaaaatgtaagcattcttaatgcagggtataaacctgaattgaattctggaacagaaaaaaactgataaaatttgaagaaagtcttgagtttagttcatggtcatgtaccaatgttaatgtctttgttttgacaaatatactagtattatatcagctattaatggaagaaaattgagtgaaaggtatacaggatctctctatactacctttgcagcttttctataaatccaaaattattacaaaattaaaagtttaattaacaagaaccaggctcgaatctaccacttactacttgaatgactttccttactcttcattaatatttttcattcatatttattaagtacctaatgtacagcagttaccacactaggaaaacagatgaaagacctatttttcacctcaaggagtttataagctaatgaaggagctacataaataaataggcaattgtactatagactctatttcctgtaataggaatataaatttctcttatgaggattttaggattaaataagataaaattttcactgtatgaaaaccagcacagtttctggtccacaagaaacacaaaatagagtttctgtttcccttccccaggggatgatttaaggatcagcattgttagaagtttaggatcaggtcagtcttgctgctggttctgctctggcttggtgctcagctgtaagaactggccttctgtcctgttcctgtgaccatgctccagcttgccctgtggcttcagttaactgggggcttatcttgctctctccttcctgattccccatcttcctcaaccttagaatggggttcttaaaagaatggttcaattcttaaaagatttgaaccagcctttgtctccatcatctagagcagggttctcaacctcaacactattgacatttggagccagatactcctttcctatgggtggtcgtcctgtgcatgcaagatgtttggcactacccatacatgccagaagctccctcaagttgtgacaagtaaaaatgtctctagatattgccaaatatcacctggggtagcgggcagaaatcaccactgataacggcttatggagacagagcttgctctattaactagaaatcttaaatgtctgatttaaggtccaaacactgccctttacaaaactggtaaaatagttgtgccaacaaagagtgtcccatactgaatatatttgggaagtgtttagatcctttattctcggccttctccaggcctttatatattcatgtacaccacgattttataagttggagctacagtgacaaccaaactatttgatcaggaaagaactttggaataatgtataaggaacacaagtttaagaaacgaggtcctaatcaaataattttgcagcattccaaaagggctaaaacttgaaagaaacaagaaagattgaactgatccttaaagcagtctgaaatatggaaatcatttttatttaaatttacgctattaatttatagcatgaactgatgcctgccatcagatatagcatgctactgggaaagagtaacagaaattcaggaaagagataaaattgaagtggtcattaaatcatctataatttcaaagcagtggaaatttcacatctgctgaagatgttttctttgaggtaaaatgtgcatatgtgctgaccactagtatattattttaacatcacactgataattaagcacagattaggactgaaaattcatagcttctccaagcacaaaggaactatctcatttgaacattttgttttataaatgaaaattctcacagttgggatttctgggtgtcccagatgaataggctccaactggtaatggccaattacttaaaatttcatttacctgaaaattcttctcggctggacttcctgaaggaccccacaaacagtctccccctacatgatacgtcaggctgaatttgtatatttcgggtcaacagtccaacctcagcagccaaacgaatgtgtcggccatcctccgtgacatgtacacttcctggggcaataggagttgtgggaaaaaaaaactttaaaaacctgtttcaaaaatcactagctggggacccagcaaacctgagaaatgaaaacatcctttcccctcagaagttctaccaacattaaggtctgcttttcctggggcattctccacaaaggtcagctgagaaataaaataacccattcacttgtctctctttgggatcagagtcagagtgtttgagcaagaattcatttcttcttaataactgtgggtactggaacaggtcactggttcagggaagtcagggcagacctgtccaattagtggggtccccaacctgccttaaataggtcagcgtgagacttcagtgttgggttgtacattgtccgtggacctctttcatgagagtgaggagtcccacatcaactgaggcagtgacagagcaaaagcagctgtgtgtaaaaggaaagcgagaagcagcaccaggcagcagcagcgccctctcatggtggatcttccactcatcacggcctgaacagcttccacagcagtgggaactaagcgtcttgctagtttgtttcactgtctaccatttgcatttcaccttgcattttactgaaatcattgctgaagatttcttttttctttgccacttactaaaaaagaaatgctcctgggaacattgatttagacagagctttagatattcctggtgaaaccatggatttgcctctcaagtatcagagacaaaaagacattctccatcccctttatttccacagtttattactgattagctatatctcctggattagatttatttattagactgaatcaggaaggttattgtgatttattatttatatgtagtacattctaactgtgtattgtgtataaaaatatttggtaccttttttatttaaaaaaaggtctgggcttttttctttcattttttgcagtaatagtaatagtagtagttaatacataaaatgtacttcatgtcaggaaggacacatttctaagtatggaaaatgaaatcattatttacagtaactacaatattctaagggattataattcaatgtgtcaggaaataaactggaaactcagtgcccataagttttattctggcttagccagaaaactgcccagtgaccttgaacaagactctcaacccttctgctcttagatttgccattataaataaaaagcaaaatgtgtgtgcatgtgtatgtgtgtatgtgtataacatccaagtattctttaaaaataaagcaacaaaattaatgagggaatagagataaggccacgtagcatgagtctaggtcaacaggaaggcattgttcttcccctctgaatggcaatcagatccgaggtccccagctaggttaccaaacatggtcttcctagctcattcacttaccttaaccaacaaaccaaagccttaccaatatgccggtgtttgagccgttcatagatcctcacatggtggcccttgacttctttcacagtgaggacctctgcttcatgaggctcataagaagaggagctaaggactattttgtcatgggggcgccaatccactgcatcttctactataattctgtaacagcataacaatggcattggatatactaacagtgcagcacaaatcatctattaactccagagcaagaaaaggaaatccactgtgaccaacatatcccaccagagaaactgaaatagaaataagacatggcagtggaaaaaggctttcgcaaacagtttaatttagctaatggagtcagttttctggcttgaaaatgtatatgttacagagacagtgaagatattcgatgacccctgaaatacagcaaaggaataaaaaacaataaaagttccagaggttagtacacatgtctacatcagcaaccttctttctggattagggaacagattcaataataacagcatttcagaaaagaacttttctctaattttctagagaaatataatgccattttttgacaactttggacattttggacaacttttcatcatgtgttacaaatcctaccttcatgatgaaacagatacaagtgtgaatcgtagaggtgtcacttaccagctgtgtgaccttgagaagtcacttcactcctcggcttcatatcctcatctgaaaaggctatatttgtactttctgtcttctctttcatcacattatgaaacaatgagggttgtgttcatttttggtatttttcaagacacacatttaatacagtttctgttcagtctttcactgccgcctagcattccctctgaatatgactgttttattttcttcatagtcattaccaacttcaacaccataaatttaattgcctgcttcattagctaatgcccaaagtttagcaagctttgataaagagtctcctctatagtgaatgttcattcagacaacagtgtccatgtgcagggcattcaatcatgcaacctttattgaccgagcaaatcttatgcaccagacaatagagtagatgctagagacatacgataaataaaacatatgtcatttgtattaaaatacataacttaaattctgcctagcacatatctttaaagagtctactgtatgggtgtgtattacacagtattctgtgtaataccatgggagtacatattaataatacagatgtttaatatatagtattaagcccctaaaaggaaacataaattaaacctaatcatttgcaagccaatggcatgagtctaataaatgaaatattataattaattcacatctacgtacctaaggttggagaaagagtcatagagaagacaaaaaaactactatcaattgatgcaactttaatgaaggaatttagagtcttagctctgttcctgatttgctatgacttcctagaaaactcccagttacagaatatttaagcaccacaagctttgaaaggcaaggaaactaagttccaaatagatttaaataacaaaatgtaagactagataaatacatggagccagtgattgaattaggacaaaggaagactactgataaagtccagcattttttccactaaataatctcactttgcctgtcttatttttagttcttcaggtgctaaatggtattagaaaaagagtattcccacttttcataatctatgaaattataagaagtctatgatccatacaatggaatactgtatagccatttttaaagtattttgttgaagagcactgaattacaagaaattttgttcatgatgtattgatttcaaaaagcaggacgtaaaataatatgctccattttttaataaaatgatacatgcacagaaaataggaaagatgcatgttaaaatgttagcctacctatggatggtgggattattagtgattttcacttaaatctcaattttctaacttatcaggtagtatattgtagttagggaaaaaaaagtcaatctgctgtataattgaaattaatcctttacttcatagttagtatttctcagtagtccccaagctttttggcaccagggaccagttttgtgaagacaatttttccacaggggaggtggattcgggatgaaactgttctacctcagatcatcaagcattagattctcataaggagcatgcaacctagatccctcacatacacagttcacaatagagtttgcatttttatgagaatctaatgacccctaatcagacaggaggtggagcccaggcagtaatgctcccttgcccaccactcacttcctgctgtgcgtcctggttcccgataggctaaggatctgtactggtctgtggccctgggggttggggacccctgacctagacaatctttttattattatttatattgttgaataaagctcttcaaataataggtcactataatattctgagaagtttcatgtgaaagtgagattaaaactcatccacatgagattttttagggcaatattctgtgtaatactatgggagtacatatacacgatcacacatttgtaaaaatccatagaactgtttaacattgagtgaacactaatgcaaatttaaaactcataaagcttcattttctaacttccttatataagccatctgctccagccagatgaatcagttcactctcccctactttgctcttcaggtctctcattcttgaaaactgacacaagtcactacggtcactatgccttcaagaagtcttcaatgggagtctctttccactgaatgcccaaagcctccccactttctgtaccaccatcaatttgacataaaaaatgctgtttattgccttgtgactggttttgtattcttgtcttctgtgaccattcaacttttttattgttcattgatatttaataaaaataagactatataaggccaggtacagtgcctcttgccttataatcccagtactttgggaagccaagacaggaagatcacttgaacccaggagttcaagaccagtctgggcaactagagtgatcccatctctacaaaagtgaaaagaaaaaaaaaatgtagcctagcatgatgtcacacacctgtggtcccagctacttgggaggctgaggtgggaggatggcttaggcccctgaggttgaaattggagtgagctatgatcatgccactgtactccagcagcctgggcaacagaatgagaccctgccaaaagagagagagagagagagagagagagagagagagagagaaaacaaagcaaacaggaaaaaaatcactatctaaaccccatagcacctaacaatgttctaggaattattaaaattattagttcaaactttatattaaaaacataaataaacttaatctgaccttttctgttctggcttcccaaaccttatgagttcattaaaatgtatctttcctctatactcctgaagtctttcgggttctatacatcatgagaaccatacacagatgtcaaaggagcattgccccttccacgtctatgtccatatagcaacagtggtaacttcagaggaaactggggtctcagtatcaatagcctagttggttctgctagtcaaatgtcagttttccttaaattccaacatccactattcctagttccagtcttcaaacattatggttacccttcaatcatacgaactagcttaacgactggctcaaaatcccagctgtattctctgtattttattcctctgattagtatgactcctagatcttcagggaagaggggagacttgcttgttgttatgagcaaaacatacctcaaataataaataaacaaaaaattaaaagactttttttcaacataattgtacctaaatggaaaccatatgagaagagagaggaaattatgaataatcactgtggaagtctttttaaagataactctaagaaaatataaacaaaatatcagtacagtttctttattttggcataacttttgacctagttcagagaaaaataatatttactagacaaaaatataatacttattatttacagagaatttaaaaatgcttcaaaatttgatttaaaagtttttacaaaaatgtgtaagacattcacgtgtaaacacctacaacttaaatgaatttgttaacttaatacttgtaagatcttaatgataataactgcatttgaccacaggctcagagtgtacatatcacaaaacatgccctgtctcacctgcacctccaggaatagggatggccacagatttctgaactctactaatatttagtctttttcattttgtaacttcagtttaaaatttttctatcagtgccattaaaatgtaatgaggattctcagactgtattattctacacttgatagagaagaaattgaattctataatgatgctggtaaagatggtgagtgacaacaattatagctatagtcaataccaattatttgtctacctgacttcctctctgcttcattccaggaaatccctcacacctcatctgagaactgctcccatccactatactgaaatctgtgagagctgcaggttaaagtcccacaaacccttcaccaaaggctgggcataggatccaacctgcattcattcaccaaaatctttcccctggaattttgaatgaaactgaggggaattagtagtaacctcctcactggtggtatagctaggaaaagccaaacagatctgagttcacttgcaccatacagaatgaagaaaactattctccagtagaaaaaaaagaggttgaaataaagaagtaaaaaagtagaggaggagaggaagggcttgatacagtcttcaaaatggcttaagaagggttacttttacttgtactttcgacttaaagagccccgattgccacaatagctgccctgtcttaaggcttacactgtgccagaaactgggcttaacacctcatgtgcattaactccctcaatccttataactattctattagcaatgtattgttactcacataattaaagaaaataaaactgaggctcagagagagtaatttactcagagttacacctttagctaaccacctaactagaattagtctgcctgccctcaaagttcaaactccttttcattgcagaatatatttccaacctaccttccaaacatatgcctttcaccagcatcataatagtagtgaatttggcaatagaacccaatagtttattggacctctaacatatgaaaaaaaatcatcatcttttagaggttacatatgtgatcctgaactcttgccaatgagtgcataaggccaccaactctatattctaatacttaaactaagttgttataataataaagtttgaggaatgagcaaaataaattatagtagtatttgaaattaaattcaagattctctcatttgttagataatatgccattgaaccaagaagctcaataagttctgatttctagaaaatacacatcaagtcaatgtagcatgcatttattggagcccttctttatgttctgctgtgcactagacactaatataccaaatcaacaataacaaaaatatatctctcccctatagaagccacttggaggaacaggacacacaaatgttaaacatcttagtgttatgcttttcttaaaattacaaatcataaaatcacatcttacgttcagatgatgggaaaatttgtagagtcggagatacctaaagtcctgtgtctgatgtaatggaatctttaaggataaataggaagttatacagtcaaggaggagatgcaagaatactgcatctgatactcttatttcatttattaggtacttaaggagccagtacaaaagttgttgtagagagccatgggtgaagtgctgcaatgagaatgtagcagataggaaagaaaaaagaaacattccaaacaaaatatatacaaagaacacatcattaatttaacataggagataaaggaatagatataatcaattatgacattcaatttaaaggtttagggcctggagaaaaggatgaggtaacaaatgacttgatttcttattcagttcacagtttcttccttgtaaataacagagtatgttaataaatcacttcagacacctcatacctgtcaaaattaccaaaacagtgaaagataacaaaggttagtgaggatggaaagagaagagaacccttgcatactgttagtagaaatgtaaattagtacaaccgttatagaaaagagtttggagggtcctcaataattaaaaatagaatatgatccagcaatccatcttctagatatatattccaaggatatgaaatcagtatgtctgagatatttgcactcccatgttcacagcaacattattcgcaagagccaaaatatagagtcaatctaggtgcccatcgacaaatgaatggataaagaaaatgcagtatacacatacactctggaatactattcagcctttaaaaagaagaaaatctggtcattagcatcaacatagatgaacctggaagacactacgttaagtgaaatgatccaggcccaagaagacaaataccacatgatctcacttgcatgcagaatcaaaaagagtggaattcactggactagagagtagaatgcaggttaccagaggctgctggtttggctggtggtggggggaagcaaaggttgaagaaatgttgataaaagaatacaaaatctcagttagataggaagaataaattcaagagatctattgtgcaacatagtgactacagttattaatatattgtattctttaaaaatgctgagtgtggatgtgaagtatccttaccacaaaaaaagataactatatgagataatacatatgttaattatgtagatttagccaatccacaatgcaatacatgcatcaaaacatcatgttgtacagcataaatacataaaatttttacttgtcaattaaaaaataaaacgaaataagtcaatcacttgagaaagaaaggataacaggacaaagagactggatgtcttatatattttcttgaaaattcaatgagataagaaatgagaaaaaaataagaatttgggggaagtttcctcataatccagctcttctccctgttttccccttctcagtaaatggcagcgctccttacctagtttcttaggtcaaaaatttaagagtgatctttgactcttctctttctcttttcctcaatattcagtccatcaggagtcatgtcacttctgtcttcaacatatatttatccacatctttactcctccatcactgccatcctaatctaagccatcatcatgtgttacccaaaaaactgccatagcaatgtcttaacagttagtgtctctatttccactcttatctcttcctcatcaccaccaccaatagtcaattctccacacatcataaatcagattaaaatataagtcaggctctgtccatgtctcgtttaaaatcttccaatggccaagataaaacctaatctttatcataagattggttgacaaagtaaccatttaatttcaaagatcacatggctacccttcaaagactcacagcaaaagatatacataacatttgtaatgggtaaaagcaattttttgtgtctaaatctaacttgtcttgatttatttacaatccaaataaaacctcaacagttttgttcatcagtcttcacaagtcaactcaagcaagcaacaacagagagtaatttagagataaattgataaaacacagaataaaagaaaataatttttcttcaaaatatcttgctaagcttactttggttgattgtgtaagatacaagcttataaagttaacatgaaacttttcctccgaagttttcacactaccattattcacatatatatatatatatattttcaggtatcaaattcttttggtgaaaattcatgaaacagttcatctgaaatatgcttatatcacaatatattagaaagacaaagacttattgaattgacttttaagattgtagagccatgtttaaaaaggtggcctaaataaggtctgtagctcagttaataccgtaccaatatcaacttgccagatttgctaatgttctatagttatgtaatatgctatcatcagggaacactgagtgaagggtatatgtaaactactatttttgcaacttattttgagtctgaagttatttttaacattttaaaaaaggttttaaagagaaagaattccataaaatgaatatactacattaattgcacatcatttgtataaactcattaaattatttctcctcaggactgatactaagaaactttgtttttaatatttgtaatatgtagaacacacgcaatggaatcagacaaatcagggtgaaaaatccagcctcaggaatttctagctttatgaacttggaacatttacttaacttctccagcctcagttttcatatccataaaatgcagataataatacctaacttatagcattgaaagatttaaatgagataatgtatgtaaaatgcttagtagaggcctgacatataacaagcttacatgataagaaccaaataaatggtagctagttaatgactatggatagttttaattaataaaattgagttcctttcaaaatagcctgtagctcagactccaaatgaggtttttaacacattcttataagaaaaatccattcatatggttcctgccaaattccagcttgctaaccttttaattataattaaagtttcttattgatccttgttagaaatgcttacttcacaaatccttttgaatatcagaaaagcactttaaattcaacatgacctaatctgaattcataatcttttctctaaacttagtcctcctcaagtgaatgacaccactatccagctacacaaaccagaaaccaagaatgcacttcatattcaatgtgtcttatagggtttatctcctgcctttaaatctgcccacttctccattgctcctgcagcccctgactacaattacactgtctcttgctgggtgtctctggatctactatcaagctctcctgctgtctacattctgcctacaatattttagatgtacaagtatgataataagtgttacctcctatccatactacccccttaaaaacctacaacagcttcacaatgctcttagggtaaaaactaaaattcttttttttttttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccccttcctgtgtccacgtgtactcatctgacagagggctaatatccagaatctacaataaactcaaacaaatttacaagaaaaaaataaacaacccaatcaaaaagtgggcgaaagacatgaacagacacttctcaaaagaagacatttatgcagccaaaaaacacatgaaaaaatgctcatcatcaccagccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaaaattcttgatattgccaatgtatgtggccctgacacttaaccaactccttggaaccctgtcatgatcagcccctactctccacatcaaccatcatggtattctttcagaccctcatgttctccattctccctcccaaccacagaatcacgtctccaccctctgcttctcaatcacctgtgttgactcctcaatatctaaaaagttagaatgcccccaatctcaatcccatgctccaaatctctcttctacccatgtcttcttcaataatgacatcacctacttccaagatggctgcttccaagccctaaattatgcatctgattttcttcttggcatctactcttggtgtctccaacttcgcatgcccctgctgccttccaccctgacaaacctattcccctctcagtcttcccaactcagtgcgtgcttcctccattcatcagtgtgctccatcaaaacacctgcagcactctttccttgcctccacatgcagtcatcaggaggaccagttgttctctccatctccactgcctcttccagagtcccagatacatgatttctggcctcaactggcctcctaactgatatcccagctctactgttatctccacaatccatcatctacacagccagagaagttttttaaacaaaaatcagattccaccatcctcctgcataaaacccttcagtgatttcccctttgacctcttatacctgaacaaggtcctgtatgacttggcacttgccatatcagacaatgctgccctctgctcactctgcgccagctatagtgaccttcttcctgtttcccccctacccccaccctaggccagctggttcccacccatccttcaggtataagctcaaatttctcatcctcaaagagactttccctgtccattcaatctaaaatggtacccttcacattttctgccccagctatttttgatcatatcaccatattgacttccttaccagcatattttataatctcaaccacgtcatttatatttctgtatttgtttgagtatcgtctttctctcaactaagatctgagctcccagagggcagcaatctcttctaatttgcaatctcttctatatgtctagtgcttacagtctgacctggcacatagtaaatattcctcagatatttgcttaataattgaatgctgtttgctctggctagaacaccgtttccacatataacccactttgcttaattaatgtccatgcttctttcagatcccacctctgaaattatgcttcagggaagccttctccaacttcccataaatgcctcaagttgacatattcatgttttcagaatcctacataacccgccccttcacagaatttatcatgtatgtaattttacatttactatttgattaacgtttgagtttttacttaatattatatctccagatcatagctcaatgtttgacaaacataagcatttgtgaaaatcatgtcaaataaataattttaaataaccatgaacataatacctactctacaaagaaattctgtacatagagaaaagcacaccaaagcatacctatcaagatagctacctatcatttcaccaacagggatccttgctgtgctgtatgtccttccagggatttccctattatgtatatgcatacatatttttatttctttatctacaaaactaggctagtatgtaagattaattcccatgtgaatgtgagcctctgctctattttgtcaacttggaattcactattttccatctttgccaaattaaaatttaaaaatggtattccattactgttttaattaatattcaattctagtaaagatgaccattttttctatatgtttattagcaagatgtattttttttgtggcttacatattcaaaccctttcacaaatatgtttctggtgtattcatatttttattttcattcttgacatataaaaaatattagtccttcatctgtactattgtatgctgcaaatattttctttttttttaattttgttattattatactttaagttttagggtacatgtgcacagggagggatagcattaggaaatatacctaatgctaaatgacgagttaatgggtgcaaacattttctagttgatcatttgtcatcacattttgtaactgacatgcagaaatattgaccttgttatattgtcaaatctattatttactgctgtggctattgttttgcttgttatgatcagagcagtctttactgctttaaattacatgtttacttaaattttcttcaaataattttatggttttaacttttttacattttgttttctaatccacctataatttagagtaaaacataaagtgggaatctaattttatatttttctaaaggatttactaattattccagcctgtcttcaactaaattcaaatgctaatttattcaaattctaaaaataatgcatgactgtgtttatttcttggtattctttttagttttggtgccaacaacagattactcatattagaggcatacatttaaaaaaaaatgctaatgtttggctattttctcttttttttggccttttattatatttagttacatttgatttatcatattttggtgtccctcagtatgttcctcttattcttttcttttattttattattattatacttcaagttttagggtacatgtgcacaacgtgcaggtttgttacatatgtatacatgtgccatgttggtatgctgcacccattaactcgtcatttagctatccctccccgctcccctcaccccacaacagtccccagagtgtgatgttccccttcctgtgtccatgtgttctcattgttcaattcccacctatgagtgagaacatgcagtgtttggttttgtgtccttgtgatagtttgatgagaatgatggtttccagtttcatccatgtccctacaaaggacatgaactcatcattttttatggcagcatagtattccatggtgtatatgtgccacgttttcttaatccagactatcgttgttggacatttaggttggttccaagtctttgctattgtgaatagtgccgcaattaacatatgtgtgcatgtgtctttatagcagcatgatttataatcctttgattatatacccagtaatgggatggctggatcaaatggtatttctagttctagatccccaaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtcagttcatatgcttcacctactttttgagggggttgttttttttttcttgaaaatttgtttgagttcattgtagattctggatattagccctttgtcagatgagtaatgtttggctattttcaagtgtttattattccaaagaatttaatgagtcagattctgatgcatacattagacctgtgattcaagttgtattagatttgacatctttaaaatagtgaaccatcaaatttttgttatgcatcaccatttattctgaactctttttatgccattgaatagtgttttatagttttgtttttataggttctgtaatttttcctaaatttacttctagatatttgcagttgaaattttaaataagcttgtacattataatttaaaagtttactacttgtatattaaaaagatgttgatgtgcatttattgaaggcaactgagagtttttcagataattctctagttttataggatgaaatatccattttataaaccacataaaaagatagtttggattattttcaataattggatctaatgtatttttcttgcctgaatatattggctaaaactttaataataatatttaatgattgttgtaacaaacgataatatttaatgtcggtttttctcctaaaatacaaaactgtttgagaggaatcctttaatgtttattttgtattattacttaaaccagtgcttctcaactaatggttataccatccaaataaatagcattaatttaaaagaagtatccttgtagtcttcatttactgtttattccaagaatgtttgctgaattttattaaacatatttcctttttgtgccaaattggtcatgttcttaatcttcacatctggtattaaggtaaattatatgaatggattatttcatttcaaattatctttgttcacttgaatgaaacacattcaaacatagcttgctttgtttgttgcttttttatttatgattttttacattctatttggatgttttctcagttttcttttttgagttattttagtagctataaacaagtgtaaagattattttaggcctgttcccttaaattaactgggaatagattatataacataggaattatttgatattcaactgattggaagaacatggtataaatttatgtgagccaaatgtatttttggagataaatctttgataaatttatatctttcactattccttgttctttgttttattcttctctagccaattatgataattctaaattatcgttaaaaattcctttttataaagtatttttctcagaaatgttaaagttgcactatatagatttatattttttacattataactctaaactattctgtacttacatttgaactgtcatttctcattttatatattggggttttcttggtatgattaaagttattagagattaaaccactacctctttttaaaaatttaatcttactaattttctactttctatttcaccaatttctgcctttttcttgcattgattgagttcattagacttatgggttattttgtttctaatttctcatattgacagttaatcttctttgtttagaagaattttttgtttagaataactgtcaatatgaaaactgtcaataagaaaagtttgtttgcttattcaatcatgaaagtatttaatgtgatgacatgttctataatatctcgtacgctatattctcattattgttacttcccagctattctgttggtaaagttttgatattttcttggatataaaagttatttagaagataatttattataccttttttcttgtaagaaattaagattgttggtttatattttattttaatctccatgtttattatattgtgatcacatattattattaaaatttattaaggtaattatggatatatattttttagggtaaaggagtagtttgatacataaattaaattgcttttattatattattcatgttcttcttgttttctttaccttttttaacctaattaaaagatttggaactgaaagagataaatacgtgtcttagatcgtgatttttgtttctgtcaatttcaccttacatttcctagagatttgctttatatttctatattgtattatctgctgtaaaacttttctgactgttagtgttttgctatgattgaaggctttactaatgtaaattataattatttaaccaatttgaaacatttattttgatttttacctgttttgttaataattttgaggctcctttattttgttttagatgtcaatgatttattcttatccaatatttaactttaaatttctcctagttggttttaagttttcctctggtaaaaaagttataattatattttgacttttaacccaatttttctatatagcattatttttaacaaatattttgtttctgtaactggcaaatttgtacttactttcttatttctgtttgttttaaatataccttttttgttgcttttattcttttaccatttcattttctttttttttctattttattatttattttatggtttctttcatttttttcccactggtgatttggaaagtatatatgctattcaaaattctagtaaaacaaattaactcatatttacctcctatggctatagttccagatttttatctgataattttgaatggtgaagattcatttatgtgtcatatttgctaagctattatacacagttactcaatcaaacactaatctaggtgttactgtgaaggtattttgtcaatgtggttaacacagttgagtttaaggagattaggccacccaataatgtgggtgggcctcatcaatcagccagaagaccttaaaagcaaaagtgagatttctttggggaagaagaaattctgccttaagacggcaaaccagttcttccgtactttacaacatactggcctgcttacagatttcaaactctccagctcccataattgtgtaaatctatcccttgaaatacatctctttatatataaatgtatgtatattaatatttactatacctattgtataatttacatacatataacaggtaggatacacacacacacacacacacacacatgcacataacctactgattatgtattttttgtataaagagaactccaactaatacattaacttttcaagtgttatgtcatttcttttacaagaacaattattagaatttgttttaggccaggcacggtggctcatgcctgtaatcccaggcctttgggaggccaagacgggtggatcacctgaggtcaggagttcaacaccagcctgactgacatggtgaaacatctctactaaaagtacaaaaattagctgggcatggtggtgtgtgcctgtaatcccagctacttgggaggctgagacaggaaaatcacttgaacccaggaggtggagatcgcaatgagccaagattgtgccattgcaatccatcctggccaatagagtgagactgtgtcaaaaaaaaaaaaaggaatttgttttgttttaataaccatagttacactataatatttaaattatttcagtgcttcttagttatttatattattctcaaattttatttctgttcccaaattttaagtttagtttaatctctttatttgaacactgaattttcttccattttccacatgagcgtcttagcagtgtgtccaattctttggtcacaatatttttttccttaaacatttatagatgtggcatcacgatcttcccacatgtgatggtgtagaggtgaatgctaaggctagaaagcttgatgttcctttcctttactttttgttcactctatttttcttatactatgaagataatgtaataaagcaatcaccatccttgatattaatcttttctaataaaatgtaactattcccatattttctatgtgtatttcagttatagtgttcattattctttctgttgtagttattctgagttcttactaaaaagacatatgacccatagatagcttttaattttctgatctctatttctagtactttatcttttgttatttttatttcctagtcttatcctctgtgtttggataggtctccatcagtttgttcttcattttacctattctttgaggaagcaatgactctgttctttactgcctccaatgcattattaaatttcacaatatacttcatatgtttcatctccctcctattttatttctgtctatatcttaatgaggtaccttttcagcttagacatagtattcttacctcatacttcatctcttatctcatggaattcatatattttaagattttatggacagcaataattatgtattatctaaaattttctcctgaaataaactgtgttcctctattaccttttgcatgttttgttctccttctgttatgttatagagatattttttaaattccctataatcgcttatttttctacttgctcatcctttaattataatgtttaacctaaaaatcagtttcatattgtaacaaaatctcaagcagaagcaacctaaacaacaaccaagaaaaagccctaagttactctcattccttacctctcatttcctgaggcaatatcagctccaagatgtgtccaggagttcttaggataagcactgtaaagatgaactttcccataaacccctgaaaataaaaggagtaacagttggatagaaaaatccttcagaggaatgaaagccaggtaagtaaaagtcattccagaggctgttgtgcaaaacatgtgatatagaatctctatatgaaggtcccatattatcaaaagcattatttaaatgctctattttacaatactaagatatatctcacatggctatgaaatttattctctcaaatgctatagaaaaaagaatgctacaccacatcacaataatctaaaaggtgggaaaatagaccactctaatgactaaagttgaagaggtactcctttccactcttacgtgactccaaaccatttgcaattcttttggaagttaaccagttttgatattttttgttacacactaggttctccaaaagcatggttaactctatttccttaggatagagttttggagctattagctttatgtttagtggctggacttaatattttgtcttataaatatcaagggagagatttctaagtcctttgtttcaaaatgcagtttatttcagactaataaattaaaggcttaggagaaatgtgcttgatacagctcagttttattttttcatgtctttcttcctatatgttttattgccattttcaatcataattcctcatattctagtggtttaaaatgttttgaccatgaacctcaccagaaaaagaaaaaacatgtgattgtgtactctcagcacatatatatttattttatttagataactcagatatttatatttagataaaaaatatacacatatatgaatatactaatatatattggaatagaagttctaatattttattcctgcacccaaatgtattgtctgcatatccctggattgatgcactgtattttattgcaagtcattaatctaaaaatttaaaaattttacaattttcatcagaaaacatagaaataaaagaagcaggagaccactaaggtacaaataatatgactttggtgttcatctgataaggaccaaaaaaaaaataatcccaattaattagaacttaaccaactgtttatatcaacatccacattttttccatatatcaactatgaaaatgtcagaagataagaaaactaaatcaggataaatggatataaaaagaaccccattttcaggacgtgtcctgaaaccaatctttcataatagcatttatatatttcataagacatcatcatctaaaaccaaaatccatcttttttcactataggctaagtaagctaggctgagaaggatcctgaagtaatttaaagagattttcaaccaaagcatttataacaaaaagcagttcatgtccttaaatttgaattatccagaaaattcaattgaccagaaaagcagatttcttggtcatttccaatcatcaaaggtttactgtaaaatgacaccatttcttagttgtttcaagaagattacaaatgatttaatacgattaaaatttgtcatctacttatgatactacaaaaatttgagcatgcagtaaaagaaatacttcattctttatttcaatttagtatcaaagaaaatttcaaagacactagtttgaccgtacagccaggatcggggatcagagcaggcatctgtggatagtcctaacagaaagtttgttccagtgttatcacgctacagaaaagagtgaataccacaggcaaaagaagatcaaatattcttataataatccatctagtttgtcaacttagaaaaattaaaacattcttgaacctcttgttattagaaagataaaataaatagcatgcatggaaaaaacctttggaaacttaaagtgctatcaaagtgttatatgacaatagttatatattatggaactaagttaagaaacttcatactagcttaacattattgcctccactctattgagtactgagatccagagagggagccattgactgctaatgaatattaaatttatatctcatagtgttcagaaacctcagaaatgatggtccttgctctttttccacaaggaaaaatgacttacttgaaaacctccaacacagcaatgcatctaagggagaatccaagaaaattaacaaccaattttctttaaaaatgttcatattttttcttttagttaatttttttctcacttatataatagttgaaataagttcactatattttattattcttttagatattgtattgtcacatagcttaaatatgataacatatttattattcttttagctattgtattgtcacacagcttaaatataataacatatttttaaatataataacatttaagctgtgtgacaatacaatagctaaaagagtaataaagtatagtgaacttatttcaactattatataagtaagggaaaaataaccaaaaaaatgaacattcttgaagaaaattgcttcatgccaagagttatccctctttacttataaaattagtaatgcccatatagaaaaagtgagaaaatactttaaatctgatgaacattctcttatgcctcaaaactgagttagttggggatacatacatatggttatacaaggccagtccccgtttctgtacttttacatagaccaatttaaaatagcatttggtattgtggcaatagcaaataaagaaattgtcaacagtgaatgttccttattaatttatagatctatcagttgtataaatgtatcaataatcgagtagtatttatagttgataatattgactcagtcgaaactttagtgtctgactaatctggatcttaatccataatgctgacactataaagctgtgtggttttctgcatgtcgttcatcatctctgagtcttagttttgacatctctaaaatggacactactcacaagagagctggtaagtgaaataataaatataaattgcctaaaagggtgtttggaatttagcatatgttctatgaatagtatttctctatcagacacaagcacacaatacacacacatgcattttatttttaataaaaactatattatactcttaccaattgttcctgggtcaatatgaattccattcatacggtcacaaaagactccctctgaggctctaaggagaatcagaagcttttgttccttttctaagggattttctaaagtacctgtttacaaagaaaagtatatcattcaaatcaatttgaaattaaaagaaagagagggagaaattgcagtataatttcaataatgcaatgtagatactgtgaagtagactatatggaggagtcaatggtcatgcagatgaaataagagtaggataaaaaagattcagtaaacttctttgaaggagactcatgtattattcaccaggtattcactcttctttctttattagggcagtgtaaactttcctgacctactaatatttatcctggtcatatgacttgctttgaccaatgaaatttgtgtgaaagtggtaggaatattagttttcagttgatgctttaagggacttggcaagttgttttgttttgttttatttcattttttaccagatctctttcaatgttgttctctaccatgaatacagaatttcttaaatagcctgtggtatctgaatgaagagatatgcagagcaaacctgaatagaatgcacaagctggagccaagttcaactaagtctaacacaaatatttcttgatgtaaaccactgagatttggggattgttacacaccattattatggcaaaacctgcctgatacactgtctatggctagataaccttcaaatctctttatatgcattttagcatttactcctcacaacaaacctgagaagtcagtataattattatcccagttttaaatatttgcacataaagaggcttacaggttaagggacttgtctaaattgatccaactattaagtaacagaatctatttgaacacagatctgtttatgctaagtgtttatttaacagataagaggttattttctaaaactaaattcttttagcagcataaagactcataaagacataaggctatgatactcagacagcagttggaattctttctgacctaattttattgatgttaacagtggagtttggtatgaaaattcatacttctatggtatgagaattgttcagggaatttgtcaaattagcgttagtgagtatggacctgaggaaggttagtttcaatggaacatatgtcttagagtacaaaaatactaaagttattaaagtcagttgtttgagaagtaactggtgggaaggtaatcccaaaattatattccaaatcagacaggttaataaaaaccaccggctatcaaatgcgacttcccagtatataaattcccgaaaagataaccaaaaatgacattgctaaatacaatgtgaaataactagtaaacttacaattgcctggttttcatcttggttgctggtcttttgagcaacataaaatcatccccccttgctgacacttcctatatacctggatagccaaaaggcacaaggtaagtctaaagcttgctacatacctatttttatagttcagccttcacagccattactctagtactctgctgaaagcaagcaagattcagacaggtaagtaaatctgcctagaggcatatagtaggtcaatgggtgagcaagcctatgtatttccaataatatgcaaaggtgtgttgctcctctgtgtaggtaatgccactcctcagctgagagcctgatgcatcatcttagtgaaaataaagatgtgctagagcagaaagaagggaagcaggggaggatgaaaatgtttagtaaatgtgtatggcgtagctgttatcttgccattacaagtctgtccagtaagctgttttccaactgtgatttcatttatttcacggagggtagtttagagtctttgggaaaaaaaaaaaaaaaaaaaaaaaaaaaaaaaaaagtggcctagcactaaagagataccagagagaaaaaagtaggacagtttttgccctagagaaatgtatgcagagtcccacaaaaagagttcagcgttcctctaaaattagagattaaatcaattatgcaacccaacactgcagcacatgtggagctttcgcagaaagtctgggcaaaattagttagcctgccgtgatattttgctatctgcaatggccagaatttggcttcctttttgtaactgagagaaaacgaaagatgaagaatagggactaagtacaaagaaggcaaaggtgacctaagagaaggaaatacatgctattgcaacataaaaatgaaatgcttcttgaatgtgtaaaagctgataaatggaaagctttaaaggctgagatcctcattttcttctcaatctagcaatcaaagaaaggtgaggtgctctctccagcgtggactttgcccctaaatgagggtagccacctctgagacagaagatgctcaggatacgcagctcatccttggtttacctttgtaaagcttctctaaactatactaagaggcatattaaacctgggcaaatttatgtattcataatgggaggaaaaataattgtcattgtgctgcaaagacattccggatattttcacatgcacaatttaattctcacaattttatgatgaatacagttgaggttctgatgaggaaactgaggcaaagagaggttaagtagcttgtcaggaatcacacagctgttaaatggcgaagttgggccttagacttaataagtaccatcctaggacgtgtggatatggaggaatagaaaagaagtaaagggaagcaggcattacttagtatgatggtgggcagtgaaggggaaacaatgtgttccagatgctaaaatcacctggagagatggtagaaaatgagttctggcatatgaaagataatcattataattatttggggaatatggtacaaatgggttccaggaacttcaaaaggtaagaataagaaaaaaaggcatttcattattttattaactaaagctctttgatggaatcaagtataatcctagtttgcacttaagcccactctgtcaacatgactcaccagaccttgtaccaagccaacccgtaagaaattatttacccttccttcaactcactctcctctgtgctcatgagatttcccagcatttatgttttaccttcatcttaactaactctgattcatccctcaaaacttggctccaccgtaatttattcctaaaagccttctatgatcttgaattagatgtccccttttgtgtgtaaaatcttctgtaccccttgctaaagtaattctacttcaagaaacttgtcctcaagaactagtaggggacaaggacaaagaataatgctcaaagttctccactgcagtgttatttatttataattggcaacatttaaaaacaccttgaaatagcaaacaattagaaatatttttgtccattttaaactccttcctttcttcccagactttttgacacacttaatagctgaaacatacaagtccccaagcaaccatatactcccttgcctctgcccccctctgccttcattcctgtttttgtcacggccaactcttacatactttcaaacccagttcagatgccacctcttctggaaatgcccttgtcaactaagtctgggttaagtgaccttctaagggctatcacagaatgccatgttttgctacaatacttctaaaactatactgtaagggccatttacctgattgcctccttctctcagtgagcgcaagaagaaactatgtattcccagcagagtttatttgaagatattttattccagaaatgtttaacttggtaatttttaccaaccctcctggagaaaacaattggaataaagaaaaataccccctagtaataaaagactaatttcaccagtaaattacaacttttaagcatttatgtacctaccattatagcttaaaaatatatactgcaaaaatcaacagaactacaaggacaaatggatatacctataatacttgtagtaaagccaacacaactgttgctaaaaaaaaaaatacaataatgatacagcagttttgaataatgcaatttgcatatttgacataacaggcatagatggaaaactagacccacaaagaatgcgcattcttttaaaccttgcacaagacatttaaaaaaactgatcatatgatgatgataaagcagtttaacaaatttttaaaaattggaattatacagcatttgttttctgactatagttccatcaaaatttacaattcataataaaaaaatttcaaaagtgagctatattaaagatctttccaattatcaaagaataccattaagaaagtaaaaaagcagccagatgtggtggctcattcctgtaatcccagcactctgggaggccgaggcaggcagatcacaaggtcaagagatctagaccattctggccaacatggtgaaaccttgtctctactaaaaatacaaaaattagcttggcgtggtgcgacgcacctgtagtctcagctactcaagaggctgaggcaggagaatagcttgaatcccagttgcggaggttgcagtgagccgagatcgcaccacactgcactccagcctggtgacagagaaagactccatctcaaagaaaaaaaaaaaagaaagtaaaaaagcaagccacagagtgggaaaagacatttgtactacttataaccaacacaagatacattccaaaatatataaatgactttgataaatcaatataaaacaggtacattcatcattaaaaaagagtaagagaacagctatttcacaaaacaagatactctcaaataaataataaatacattctactatgctcaatcatatcataaaaaagaaataaaaattaaaacaagaatgagatctcactacatatccagtagactggatttataatgtttaattaagcatatatttttcattttataaaatttgttgtatatgtgtgtcattttccacaattaataaaaatatgttaaatgactatgttccgagaatactcttcaatgagttttgttgatcaaaagaggggaaactggccaaaattttagtcacatcttctgaatatactattttccaggtgctagtcactgaatccaaagcaacaaattgtatttttatataatttgtatttttatctgagttaatcttaaaactctataaatatcacgactgcacatgaaagataaagaaattacccccaaaataaatttcgtacatttttcccttgtcctcagaagtgggttaaatggtgtttactttggaagttgagcttctacccaaagcataaccatttttctcatgccctgcaatagcaattttctgaagaccagagcctctagaaccttcttactatcatataaacccaagctggtaaatagcactcaaccaagtaaattgcagcacatatttttttctgaattagcttttaattcccagtgtatatttgactcgcttattcctaaaacattcctctccagtagaactgattccatctgaaaataaatgtagggtagaatggggcttgcagtccagtaagataaaaattggttataaaaatcagtaggcattatcaaattataatgtccaacccctcataaagtgattttattcaggctaacaaattttcatttttaatgaggcctctcaatttttcaattaatggaatattaaaataaacatgaaaatatgttattcattcactacttgcaaaatgtacaaaaattctgaaaacttcctccataaggtcgagcaaattacctcatttctttaagcctcagcttcctcaatgataaaataggcacaataatagcatccattttttgtgaggttaaatgatttagtccatgctaatagtatatggcacagtgtctgtacataatacatgtttttaaaaaatgttggctcttagcaatattaataatagtagttaaaaaaacagtaatagtaaccatggaggtatcacacttatttaaaattaacctttaaatttgaaaacttaaaaaaataaggcaagctcttcctagcaagtaatatctaattcctaaagtactagctagacactagacatttcaaagcaaaaatattaagtgactacttatttcaatggccagcccaaggaacttcagaaaacacaaagtttaccttaaactgaaacattcctgtaagttttctaactaaaaaaaaaaatcattcattcatttattcactagctttcctaaaattattttgtttgtatgcaaaattaaatagtttataataaatttatatgattaattattttaataactaaataaatccttaagaaatattatattactgttatatggattcatgaatcaaaagtacagtttaagaaagactgatttaaaaattattaaaataggaaagatgattactgcaaatgcctttagtaaagactaactgatgtcccaataggacagaagaatatttatttgtattagtgtttggcttaaaaaatatattaaaactacacacacacatatagatttaaggataatgtgatgttgtgagagaactaatatccatcagaaaataaacagatctttctattcttaatatcattttgaaataagtattatttaactgttggctgccagccttattagggactctccaagcacagaaatgagttttagtgtttcctgaacctctaaggggcaaaggttttacacttttgctcctggttaaatggagcaaatggttaaatggttaaataagtaacagcttcaaaagtcacatcccttttatgtcacctttttattttatcaaacaaccgttagtttgattagggaactgtgcatctaaataaactgaactaaccatctattttgcaggtatctatgtacacttatattatacacattgcatatgtgggtatttgtgtcattttctaatcatagttaaatctgaaggaggacatacttttttaactttgtatatttttttaaatgaacatcacatacaagattctctctggctgctcaatgggtctgactactgggtattgtggctttaagctggaggatatgttttaatctacgcttttctcaggtttgtctccttcttattacttaatcatccaatgagccttacagaactgtcagtttgaaaggcaataaactgtgtatggatttttcttcttctttaggattgagaaagtcccaatcatggaagcaatgaaagaaacttccatatacctagtacttcgtttcctgacaatcaaaggcacgtgctaatgatgaccttaggcttctggctacaaatgtgagacagggctgacaaatacccatcactgaccctgaaaaacaatatgtgacaagttttaggataaaagcccgagtgcctaggataattactgagcaactagacagtgcatcatgtgacctggttgtgacaggccaaagaaacaatgaactgctgtgtccccagggataccaatggttggggcatatcttgttgactagggatcaaggaggtttctattaaactttaaatatccattaggatatgtgtttcaaaaatgtatttttacaatacaaataaattttataaaattatataaatttattattttataatatttaaatactatatttattttatattattttaataattaatacaaatgtattattggtaacccctatctgaagtccttctaaaaatattaaaagaagatttttcatttgcagttttaaaagtacaatattaaaacagtctttattgagttgactgtttgggtcaataacaagttaacagcattgatatctaaaacaacaaggaacatatttgttaaagcatgagaacaatgtctcatataagaggagacattgatgaaagggatgggctcagacagctattcatgggcaaagcttttatatgtttaaaaaaacatttaaatcaaataacaaacaaatgtttattgaacaagctttgagtgggggacatttttaagtcagtttcctgttctaacagattgtaaaaatgaaaatactttgaatcctacaacacatcaactttttaaatttgtttttgtaactccttttttcctttcacataggggataaatatattgtagtcatttaaacattaacaccataatttcttcctcacagatgtagacatttaagtgtaaggagattgaatgttttccaagaaaaaggcagtgagctgaaagacaaacctaaacatgcccattcacttatatatacattgtcagtcataacagcatattatcagaattctataatgcagtaggtactagggttataaaatgttctgattaagtctatcatataatggagataggacactaattaaaacatgctattcatatcattaccgaatgcagtaatggcaacatgaatgagtagcacggatcagaaggaaaggtaactgaaatctactgcatggagacaggagaggcttcatataggttggtgcaaaagtaattgtggtttttgccattaaataataaaggtagtccttgggcaaaggcttgaaggatgatatttaagatagctaaaacagccatttgtcctggtcctgttttttgtcagctctgagaccttgaaacaaatcaattatctctctggatttcagtttccttaccaataaaacgagacagacgtttcaaacaatcacagagatttgcaacatcacagttatgaatcttctattggggaattttccagaaattgtacaatgagttactaaactaaaatcacaattcatgtctctggaatttccatatttatgaagctaatttctgtcttgttaaagccatactcaagagactatcaataagtagcaattctcagcataatttggactcatttagaaagcaacactgtatatctcaaaatctagcccatgaaactcatgacgttcactataaactcactactattcactattctttagctacaggggctgcctttctgcctcacgactaccacacaaagcacatttctccctcgggacctttgcactagctctccctcagcctgaaatgctattgttcaagtcttcgcaggtctagctttttcttgtctctatagtctgatgtcacattgacttgttagaaaggtctttactatctaacatatggttgccagcatccaacctggacctctcattaattacttttcctatttaatttctttcagagaatgtattaccatctaaacttatcttcctcatttattttactatttaattgtctgtttcccccaataaaataatgcaagcaggaattgttcactactgaatgtcttgttcactgtggaatattcaaatgacagaaagaatgcctgaaactgagttggcattcaatgaaagagggaggtgggaggaggtaaaggaggaagggacaaatctacaaaggaaactttggaaaatcaccatatcagaggaattattttctccttagtatcgatctattcatttcatttcaccatccaaaagaaaaccagttattcatgaaagcaatcctataaaggtttgatgccatgactcaatatggacaactattcattttcaaccatgaaattcaatatgttcaatgacacctcaggctatatactaaagccaaaaaatgaagttgttaaagaatagataaatggtattgagtttatgaaaagttattgctcctgaagcagtaagtgttgcatttttatttgttttacatgaaaagtaataatttgtgtcaaaactgtatttatcagccattataaaaaacaaaaagctggaataagatggccaattttcttttctattttctttgccatttccactgtatctcatattactgactacttcctcttgtaaattgcctcttttgtttcaagatattattttcctgtcatttcattttctttccacctatataactgtttctttttcattcttttcctgaactcagcttcctctaccacccttcaaagacttgcgctcctcaaaatttctatccacaaaatctgtttggccagttttattcacacttttaatttcacatttgagctgatgatcctcaaatatgtacatttagcgcagacctctctcactggtttctttattcataaatctgcttgttctctagatattatcacttagatctttcactgaaatctaactttgaaatttatgagtctgggtacttaacaaaccaatgtataaagtttactgtatactcaacattgttcaagcattttaataaacattaactaatttacttttttaaaaactctatgaaatacgtactattattatttctactttggagataagagtactgagacacagctagttcatataacttgccgagggccattcaactaatgagggatggaaagggcactcattcctggcatccccattggcccagatctcccaacccgaaaccctggatatatcccaaataactcttccttgcctcagatcaaaattctcactaggttctagtgatttttacctcctcaatgcttctctaattaattctttactctttaactcctgtaccttacttcactccctgacgatttctttcctgaaacatctcagtaggcttctcacttttcactgtgtcccttttaagtgcattctctacacttccagcactaatttttctaagaataaatataatcatgtcacttccttgcttaaaactatccagtgactacccactgccttcataggaaaatccaaactccttggcatagtatatcaggtcaaggtgcttcatctactaccaccatttcatacaaagcctacaatccagacatacccatcccctacagtttcctaaaagtataatgctcatctaaaatatgtacctgttcacatctcttcctttatctttaagctccctctaggttggaagacatgatccttccaatcatgtttttactcatttgtcacactattttattgagacacctcttgaaagttcaggttcatgatttctgtttctatatgcccagtatcccccatggtacttggcacatggcagacgctgagtaaacccatgttaaatgaaagaatggacacacatgtgaaattctttaagcttatcttaactgttttatcagactaatgagacaagcactgaacgaagaatgaaattgagtttggcatttgtgatgcagctatggccctctaagcaaagctttgatcttgagcttcctttctaattctagcattctatgattcaactctattaaaagtccattgatacccttgccagcaccagttgccttacaagcaggaccaccggctgggcatggtggctcatgcctataatcccagcactttgggaggccaaggcaggcggatcacgagttcaggagttcaagaccagcctggccaacatggtgaaaccctgtctctaataaaactacaaaaattagccaggcatggtggcgagcagctataatcccagctacttgggaggctgaggcaggagaattacttaaaactggaaggcagaggttgcaatgagctgagatggcgccactgcactccagcctgggcaataagagcaaaactccatctcaagaaaaaaaaaaaaaagcaggatcaccaaaaaatataattccacaatgttgggacttggatcaaatggcatcagatagcaggcatactctggcagcactctgtgccaatgtccaaatctattaagtttgtttactaactagtcttattatctgtttcatgttgggatttctttaggatgtggtaaaattggacagatgggttgaaagtcttccttcaggcacaatacacatagcattgggcagatgggttccaataacctacctttaggcctggaacacatggatgaaacaaagagaaaaagaatacaccactatccagtgatgggtagaaaatagaattgggaatggagaaatttttaaatgagacctgaaatatataaagtaaaactggaaagtggcacagtgtcacttaccttcaaaggtacaaatttttcagtcagcaagctatatattatagtaatgagtgaccttagaaatctaaatgtaacttactgaaaaaagagatcaatcttagcaataaaagatatcaactggaaataagttttgtagtaacaagaacagggctcaactgtatttaatatctctcaattaattggatgaggattttacagaatagtaaacaaatgggcaaatggcagtaatctgtgaggaaaagaccagacttcaagagaatatctgcagtgtagaaagatgaactgaaataattaaatgaagggataggtaaaaagtattgcccttagattccctcaaaacccaagggaaagcaaaatcagcccaatacaactgtacaatgtagagatatgtatttgtggcagcacaaatataaagagcaggaattagagctgacagtgtagttggcaggactaatggcatgacctggctggaaaaagaagttagtttaatatttgactgtattaacagaagaatcatatctgttctgatagctggaggctgactatgctggagagcttctgttgacacctccatttccaaactctgtgcttctccaccctacccagtgccccaggatgtggctgacctatgtgtactgcatcaaggagttctcctttattctgacttctcctttattctgacttccagtcggatgtggccaaatggtagcacaagcagaagacaggagggaaacaaaagaatgaggtaagagtgtttattcctatagttccttccatgtactggttaaatcccagccatacaaaggccatgcctctgggatggtctgacaaccatctctaaacctccctctttatctctgggttcctataacattcttttctcaatcctttatggcaagaggtagtaaggataactggctttatgagccctagggtatacctcatcccatttggatctttgtaaatcatttctttatttaaatcccttcaaactgtctaatgcatatgacatatattttctgtgggcaccctggctgataaacatttattgaacacctactacataccaagcacttcctatgagttatgtttaatatccctctgaagaaggttctactcttatcccacatatgttgcagatgaagaaatgaaggtgcccagaggttgacttgcttaaggtcaaacagccaacaggtggccaaggtggatttggacccccaacatctgacttagagcccattctgttaactgctatactcatctcactctgttcagaatagtcagatcccacctgggaatagttctttctccctggctttcagaggaattaaacaaaacaaagttgtgtttagaggcaatgccaataagaaagagggaatctcataactatgggaaatggggtgtacaaatttgtaaaatttttctgaaaagcaatttggcagcatgtattaaaaatcttaaaatatgttcttatccttaggcccattaatttcatttttaaaagcccatcctaaggaaatgaagatatgaataatgatttaattattgaatgttcattgcagagtgagttacaaggacaaaaatctgaaataacttaggtgcttaacaatagaaacatggctaaattattatatatacatgtatatctatatattcccatatattatataatgttgaaattattgaagttgggcctttgaaatataatgagttgtggaaattcttacattgtttatacaggatcaaaaaaatcaaagtatgtaccctacattttgaaatacatgtgtgcatgtgtatgtatgtgtaagaaaaaaaatgactttgagataaaacaccaaaatattaattgtggttatatttgcacttggaaatatttgcacttggaaactttgagtgatcacttcatttccaccacataattctctttgtttttctgtgtttgcagttttgtaccatagactaaaaagaaatacttaaaacagcaataactatgaaccatggttataaactgtatgacctaaaacagaaaagattcaaaaagatgtgaatgaagggctatagaattaaaaggagtaagatacttgtcctgaatggctcaaggggaagagcctgaacctatagaaattagaggaagatagattttagcttaatagaacaaaaagaattctaataggattttaaacaatgggaacaggttgccttgaaaggttttgatttttttgtcactggaagtattcaagaaaaggattgaccatattttttcagaaatatttttacagtaacttaacctttgttcaggtaattagacctagaattttctcccaactgagattctaaaattttcatgctacctaacaaggatatctaaatatttccttaccaccagagatatatttctttggaataagatatgatttttttctgggcattctctttcaatcttcttcctggggcaaagtaaaatgccttactaaagttctaaattagttcctttggagacagggtacatgtcttttcagcatttatacctattgcttacaacagttctaagtatatagtctacccataacatttcaggtttttttatttaagtaagccaaatctggttaatacactaccctagatccattccattctgcctgtcctgtggcctcaacaacatgatccacttcccagcaagaggagcctcatctccgagcacctactgattctctggtccttccactagctacccagggagccacaaaaataacaaagtcagaggagttaatggcatggaatgggccaggtgagatgcttgccttctcctcactacctcttccatattgtcccaagatatggtggttctaataaggcttctctcaagatatcccacataaccaagcaaaccaagcatgcttctttgagaagctgtggctaccttgtatttgctttccctccctttcctcctcacttttcttttcccttcactcacacatctttgggattatttgtcccagtaaagtgctagcacatagctttgctttcaagtctgttttcccaggaaattatgttaagacaacaattgaaattttattgtgagttagttgatcagatgatatcaaatccatcctatgatatcttctgaaagagcgagttaaaggcatattctgacacaaagaaaacctaaaggaagaattgatctgtagcctggaggaggtaaaaaatcaccctggaatgagcagtagcaggcggaccagaaacagcctgatagtacacgggcatgaaagaatgaccaatacaagccacctctgaccacatgtaaagcttgccgaagagcaactttactggtgcactcactactaccttaaccctccctaaactctgttaagcaacctgcttgatgataccatctgtttcccagagccccttctcacagaatataattctcaacatgctcgcaatccttgtgcctttactcaccaactttcagctccccgcctgcaatgaccatgcatgccacactcagaacattgcttctgtccacagggaagtctaaggtccccatcacatacagccctttgaagaatggaagatctgtatccacaaggacagttctgtctgtggaagaaaaagaaattgctcagatatgtcacaaaaacaagaattacgtgtttattctggggttctcccagcagtttgggagctgtgtacagtgttatctaaaccaggacaggtatagcaactggaagaacaaatagtctgccaaaagctaggacttactgaacaggaaaataagttctgattgataaatgctgcaattgcttaacataccacattcatggacaaaatgcactgcttatgcaccaaacagctgccccaagtctagtgcagtggaaacacacagatcgaatgagctccctaccctttgtcctgtctcttcacttttggctctagtttcagggatgtacagaacagtagacatgacattggcctctgagggaagactatttggatgtgaataccaattctgctacttactagctgtctaggcaaataactttatctctctgtgcctcggttatctcatctgtggaatgggaataatactaaaaacaactgtttcgttcacaggactttttgtgagggttaactcatttaattgagttaatagattgaaagtggttatacaatgttagtaagctatctctaattccctaagtcccattgtgtaaggtaaagtacatggtgcatgcttaataaacgcttgatgttattatttttactgttgtcccttagcttcccatgcttatagtgcttactggacaatttaaaatcattatattttatttcccctttcataaaagcagtcttcatataacttcagaagaaataatcatagctgttgcctgagatttactatagagtaatatataaacacaacattttcatttaaaacaataagtatttcatgtatgccaaagcattaagtgttactttctgaaatttagcagtaattcaacactataaatgacatcaaataaagatttttgcttaaatttctagtaccataatcaccaacacatgtaaagatttataaggaattcttttgttagtataatctcatctctcattctaggaaacaatgcacttgctcttcttaaggacatgcccaagcaaattaacttgtcatgagttgtctttcctagcccctccctgcttcctgcattataagaatggccatgccctcctgtggcagagactatagggttgtaaaccaaccatttctcttgttttcctaagttcacagttagactacagtttccacctcctttgcaggttgatgaagccatgtgactgagttgtagccaataaaatgtgggaaaaattaaagtatgacatctctaggcctgttccataaattctgtatgccttttccctccccttttctctcagttagatgtagagcagtggttctcaaagtatggtcctatcccatcaggatgcaaagcaagcattagttctgctagcaagctattctctctcctcactggctccaccactctccctggggaaacaacctctctcttttacactccagtgacaccctgtacatacatctatcagagtactgagacacattattcaaattatatacatacattattgtacgtgaggaagtaactgtcactgggctggtcctcagtgtgattatgacttcctctcccactctgacttccttaagtgaagagatcattctttttctttttaaatccctagtgtttttgcaatactgaagataaagacactaaataaatgtcgtccagatctgttgagtttaatcccctacataccttaaattcaagagctcattgatgactggtacaaaatgaatgatcaagctaaacagacaaaaataaatatatatcttaatctcatctctagcacttttcaaaatattcaaataaaagagtgaagtacctagagaatgttctaggtttagcacacattttatgggttcatgactttaagaattatttgaagcaaaatttgtaaaaacaagagggttttgcctccaatttatttacttatttattttattttcatcttttattttaaattcagggatacatgagcaggatatgcaggtttgttaacacaggtaaacttgtgccacggtggcctgctgcacagatcatcccatcactaaggtattaaacccagcatcaattagctattcttcctgatcctcttcctcctcccaccacctgccctctgacagaccccagtgtgtgttgttccctgccttgtgtccatgtgttctcatcacttagctcccacttacaagcaagaacacgtggtattttgttttctgttcccgtgttaggttgctaaggataatggcctccagctccatccatatccctgcaaaggacaaatgagataattctcattcctttttatggctgcatagtattccattgtatctatgtaccacattttctgtatccagtctatcattgatggacatttaagtttatttcatgtctttgctattgtgaatagtgctgcaatgaacgtatgcgtgcatgtgtctttaaaacagaatggtttctattcctttggttgtatacccagtaatgggattgctgggtcgaatggtatttctgcctctaggtctttgaggaatcgccacactgtcttccacaatgattgaactaatttacactcctaccaatagtgtaaaagcattccttttgctccacaaccttaccagcatctgttgctttttgactttttttttttttttttttgagatggagtctcactctgtcgtgcagtggcgtgatctcggctcactgcaagctctgcctcccgggttcacaccattcttctgcctcagcctcccgagtagctgggactacaggtgtccgccaccgcgccttttttgactttttaataatagccattctgactggtatgagatgatatctcattatggttttgatttgcatttctctaatgatcagtgatgttaagctttttttcatatgtctgttggctgcgtgtatgtcttcttttgagaggcatctgttcatgttctttgcccactttttaatggggttgttttttcttgtaaatttaagatccttatagatgctggatattagacgtttgtcagatgcatagattgcaaaatttttctctcattctgtagcttgattaccctgatgatagtttcttttgctgtgcagaagctctttagtttaattatatcccatttgtcaatttttgcttttgttgcaatggcttttggcatcttcatcatgaaatcttcacctgtgcctttgtcctgaatggtattgcctaaattttcttccagggtttttatggttgtgagctttacatttaagtctttattccatcttgagttgatttttgtatatggcttaaggaaggggcctagtttcagtttttctgcatatggctagccaattctcccagcatcatttattaaacagaatattcttcccccactgcttgttttttgaggtttgtcaaagatgagatggttgtaggtgtgcagtcttatttatgccttctctttctgttccattggtctatgtgtctgttcttgtaccagtaccatgctgtttggttatgctgtttggttactgtagccctgcggtataaagttgggtcacatgatgcctctagcttttctctttttgcttaggattgccttggctattcgggctcttgtttggttttatatgaagtttgaaatagtttttactaattctgtgaagaatcttaatggtagtttaaggggaatagcaatgaatctataaattgctttagatagtatggccattttcatgatactgattcttcctatccatgagcatggaatatttttccatttgtttgtgtcatctctgatttctttgagcagtggtttgaagttctccttaaggagaactgttcacttcccttgttagctgtattcacaggtattttactcttcttgtggcaattgtgaatgggagttcatttgcgagttggctcttggcttgtctattgttagtgtatggaaatgctagagatttttgcacattgattttgtatcctgagattttgctgaagttgcttatcagcttaagaagcttttgggctgaaacaatagggttttcaagctataggatcatttcatctgcaaacaaagatagtttgacttcctctcctcctagttaaatatgctttatttccatctcttgcctaattgccctggccagaacttccaatactatgttgaatgggagtggtgacaaagggcatccttgtcttgtgacagttttcaaggggagtgcttctggcttttgcccattcaatagaatattggctatgagtttgtcatatatagcttttattattttgaggtatatttcttcaataatttattgagtttttaatttgaatgtatgttgaatttatcaaagggcttttctgcatctgttgagataatcatgtggttttggtctttagttctgtttgtgtagtgaatcacatttactgatttgcatacattaaaccaaccttgcattccagggacgaagactacttgatcatgctggataaactttttgatgtgctgctgtattcagtttgccagcattttgttgagaacttttgcattggtgttcatcaataatattgacccgaatttgtcttattgtcaggttttagtatcaggatgatgctgacctcataaaatgagatagggaggagtccttcctttttaattcttggaatagtttcagtaggaatagtaccagctcttccttgtaactctggtagaattcagctgtgaattcacctggtcctgggctttctttggttggtaggctacttattactgccccattttcagaactcattattaatctattcagggattcaattcttcctcgttcagtcttgggagggtgcatgtgtccaggaatttatccatttctcccaaattttctactttatgtgcaagaggtgtttataatattccctgagggttgtttgtgtttctctggggtcagtggtaatatcccccttgttgtttctgattgtgtttatttcaatcttctctttcttctttattaatctagctagcagtctatttaattagtttttttttcaaaaaaatcctagatttgttgattttttgaaggcttttcatgtctctatgtccttcagttcagctcagatcttggttatttcttgtcttctgctagctttgaggtttgtttgctctaggttctctagttcttttagttgtaatgttagattgttaacttgagatctttctagcttttagatgtgggcatttagtgctataaatttctgtcttaatgctgctttagctgtgtcccagatattctggtatggtgtatctttgttctcatgagtttcaaataactctttgatttctgccttaatttcattatttactcaagagtcattcaggaggagaaggttgttcatttccatggtgttgtgtggttttgaatagatttttttttttttttggagacagagtctcatcactctgtcacccaggctggagtgcaggggtgtgatatcagctcagtgcagcctcctggattcaaatggattcccttgcctcaggctcctgagtagctgggattacaggtgtcttccaccatacctggctaatatttgtatttttagtaaagacagggtttcaccgtgttgcccaggatggttttgaactcctgaactcaggcaatccacccacctcagcctcccaaagtgctgggatgacagctgtgagccactgtgcctggccttgaatagatttcttaatcttaagttctaatttgattgtgctgtgctatgagagactgttattatttcagttcttctgcatttgctgagagtgatttacttccaattatatgatcaattttaaagtaagtgctgtgtggtgatgagaacaaggtatatgcctttgttttttggtggagaggtctatagatatctatcaggcccactttatccagagttgagttctggtcctgaatatttttgttaattttgtgtctaaattatctgtctaatattgtcagtggggtgttaaagtctcacactattattgtgtgggaatctaagtctcttagaaggtctctaagaacttgctttatgaatctgggtgctacagtattgggtgcatatatatttaggatagttagctcttcttgttgaattgaaccctttaccattatgtaatgcccttctctgtcttatttgatttttgttggtttaaagtccattttgtcagaaactaggattgcaacccctgctttttttctgttttccatttgcttggtaaatttttcttcattcctttattttgaacctatgtgtgtctttgcatgtgagataggactcttgaagacagcacactgatgggtcttggttctttatccagctttaaaagactctatgtcttttaattggggcatttagcccatttatatttaatgctagtattgatattgtgtgtatttgatcctgtcatcatgatgctagctagttattttgcagacttgtttatgtggttgctccatagtgtcactggtctgtgtatttcagtgtgtttttgtagtgactggtaacagctttttgttttcatatttagggcttccttcagttcttgtaaggcagatctggtggtgccaaattccctcagcatttgcttatctgaaaaggatcttatttcactttcagttatgaagcttagtttgtccagataagaaattctaggttgggggccaggtgcagtggctcgtgcctgtaattccagcactttgggaggctgaggcaagtggatcacttgaggctagaagttcaagaccagcctggccaacatggcaaaacctcgtctctactaaaaatacaaaaattagccaggcatggtgatgcatacctgtaatcccagctacttgggaggctgaggcacaagaattgcttgaacccaggagacagagttgcagtgaaccgagatcacaccactgtactccagcctggggtacagaggaagactccatctcaaaaaaaataagaaagaaagaaaaagaaattatgtgttggaatgtcttttctttaagaatgttgaatatctacccccaatctcttttggcttacagtgcttccattaagaggtctgctgtttgtctgatgggcttccttttgtaggtcacctagcctttctctggttgcctttaacatttttgcctccattttgaccttggagaatttgatgagtatgtgtctacggaatgatcttctcatggagtaccttactggggttctccgcatttcctgaatttgaatgttggcttgcatagctaggttggggaagttttcctggacgatatcctaaaatatgttttccaaattggtttcattctccctgtctcaaagcaagagttttatacaaattggtttatatctgttccaacctatagcacactcaaccaatattcagctattaaacctgattgtacaaaacaataaaattggttgaactaatgctttctctcatccacagagtactcacacatacacataaaagtatgatagtaggtgcttttagatgtatttctcagctaaaatatgacaagtacatgaagttttaattatacccctttcagaagaaattttccctttcaattgccctaccaactccaaatgtaccaacaaatttcccatgaatcacagacagactattataaccacttgagaacaggaacacagctgatgttctcacttttattttctcaggacctagaagaataatatttaacccataatagatggtcaaaattaacaccacacacacacacacaagcacacgtgtgtacacacacataaattccaatagttatctaaggaaaagtatagaatgaagacaataacagaaacattagtcttatttcttttggtgccacactcttcactttgaaattccctggattcatctctccattttttcttctttctttctttctttcctttcccataatgtgacaaattttgaggtggtaggaatttaaacatgagtaagtcatgtttcccaccatcagatgaaaacaggtatatatacaaataaataatgtgatatacttgaaatgatgacatactttttaattacatggaggttgactctgtttttattcccagctgcttcaaactggagtctatcaatgtgtctattataagaaaattctgctaaaataaaataagcacatgccatatagagatttttataaaggcattctccttgtatcacaataataaatatttcagctagttacatgagcaaaagaattcaccctaacgtaccctccagagcagatcatctgcaggtctaaactgacaaatcctcagctacaatgacacttgcagaggatttctctcttttgaggagtggaaagctggcatctatgtgccacattctctagaattaacatcctttccataaaattactcaagatatttcagagcaatcactcagaaatagttatttatacaacttacttaataatataagtgatggaccacctctaatttaagtgtgttccagtgctttccaccgtgtcctgccttggctacagatattccaccctatcctgtcagtgaccaatctatcctacttgagagaatcagcactggcatatggagggaaccatctggaatttctgttgctcaatgggtggctgatgggggagctgatctggaaagaggctccaaaaagaattaatgagttccagatgtaattaaagactgcttttccccccaaaggggctcaggactagccatggggtggtgcctcttggttccgaattacaccctttaaccacttgttcatccatcaagcactaaacaccaccatctttatcctagtgtgttttgccaagcagtgttttggctttttggtctttttttcctgaaagtgttctatttttacaattagaacactaaagctttaaaaataatatctggaaagttaacaataaggagaaacccctgaatttatccctgcaccaaatgcaacaacaacaacaacaaaaaagactcagtgttttattagaaatgcattaactagcctcaagaccagaaaacctgagccagactgaaagacagatgtctctgaaagagggctggggcttcttttgtatcaagaacaatttgactaccacagttacaaagcattccatgtaagttgaacgctagatttaaactcactttttttcccagcaaagtagggaatcaaggtcactattgtgtagcattccaagggtctgacacttgtctaaatcctgtagaaatgagatcaagggcaaagggcacagatcctgggaataatgatggggtcacatgaacaggcataatttagggcaggcagacccactgcttgtatggtatgcactgtatcaggccccataacttaggtggtaagacagtttctattacaaccctgctattgtcaggaaagcagcctgtactgactttggacacagctcagacttctgagggagagcaatggcatgccaggcagagcaggacatacaaggactatttgtgggcttgttattttcctgtaccttccataattaatgggttttttttctacattcagccttggctcctgtgttttctattaaatatgtgaaccaaaggaaaagtaaattttaaagctatttgaatcactattaaatgatctaatcttcctttgtagaaagaaaatatttttagctccaaagtgactgctttaaatatacattttacacaatgattggtgatattttctttcttttgtggtctcgtttaactttggaggcatctaacaatttatttaaatagtctatcataatttataaagatgaatgataacatccaagaaaagtattcctaaaatagaatggaaactcttatacataaatagttcacagagatgaaagatgaacatgattgaaaattagtgtcaagtagactaatttactgagatgatggtattcagttctctagagttcattctcttgtagaaaaagctgaccagagatgtgctagaagataaggatgcagtctttctataactaaactcttttcaaagaagtgctagctttatagtctgcctttttcatcaaatccacacaggtggtttctttattctactctgcccatcattttttttcaaactggtcttaaaaataggcagaagaggcagtttcaaagtgcccagaggcacacgattcaagactaaaagccagtttcctgacaccctgaagaaaaaccatctgctggcctgattgtgtgtgtgtgtgtgagagagagagagagagagagagagagacaggatggaaggggaggagagaaaaatagctcttctcactctcacctcatgagaagagtcccatttaaactttggacaataaatccccatcccactccccacattctttctgtgtctttttcaatcacacacagacatgcataattcccatagtagaataaacattttaaattatgatattttaattgatcaataaaatgtttaacatacaatgtttatttcttcctctagtctataccatctgttcttcagaaatattttgaatctatttaataggaaggtttttaagtaaaattaccaactgtatcagatcagtcctctgcatcccaaattctgaaaggagaataccagaaggtgctgctgttttcataaaaatagaaaagaatctgtgccttctctcatcccaggctttattattattgttttaaatctagagacggtgctatgctactgttctcttcatcagacttcaaagaaatcagagtggacgacatggcattgccatttaaaccaaggtctatagttgtcaccttgctcagatggctcaaggcaaaaacaacaacaacaacaatcaaacaaacaaaaaacctagaccttgcaatccccagaagacctaaaaaggaacaatatgcattttgataaattttaggtctgatgttaaactacagtttggctttatccacataattctattacctgtatacattgttaatgaattctaactaacatgaggtttggagataaaatccctctccaatcctgtagtgaataatgcttaatatgtgaaaaggcataaactggcaactctcaggtgatccaattattaaatttttacatgttacagttggtgttaaagccaaactaagcgccaaacttattttcctatgtgggtttttgttttgatttgtttccttaagaataataacatgatcaacttttagtaaataaatatattttgtacttttaccctgaatagaaaaatatgaatatctatgaaataagtgattcactcctgaacggtgctgtttaggcaaaggtccagatatcaaatattgtatcaaataagtttatttctccccatcaggtcttttttgaaaataaatcttctctttttgtctctgcttgacactagacagggcaatatatccaaaaaactatgagattctttaattttcctcggtattattgactttttttcttaagttctcaattgtttcttctgcaggaaaagaaacccaaaagattattaaaatcttaaaaataagatgcttgtatcctatttgtttgttaaatatacatatattatatcaattataattgatgtttaagagagagtttaaaatgtagtatctgagtaacaaatatttagtaaataatctctactttctattttaatatgttgtaccaaaatttatattttctgagcaaaccaatctatatgttgtgctcctaaattaataaagtgcttatattttataaagtacaaaataacttctgtagaagttgtcattgttctcaatatttttatattttccatattttttggaaagtccccaaaaattaactcccttaaaagtcttcttgtaaattccagtaaattacatgtattcaaagcaaggagttcttgcttggggtttccaaaatatgttattttccacttgaattcgaatattgtcccagagatcatgaaggttcctagaatgtttattcacaattctaactattctaacaataatatctggattctacaacctctatcaaaagtcccaatactctaaaatatccttgcttggtaaacatactgaaatccttgtccttagagttaattcctctttttaatccaagatgactagaagaccccaggagaaaaatgatatataaagaaaaggtattatcactgaccaatacatttgctcattcatccattcattcacttagcaaatactaccaagtgctttgtcagacactgtgatatatgccaaagaaacaaacataaataaaacaaggctcctacttcacatagagaagaaattttttttttgagacagagtttcactcttgtcacccaggctggagtgcaatggtgcgatcttggctcactgtaatctccgccacctgggttcaagcaattctcttgcctcagcttccctagtagctgggattacaggtgcccatcaccacgcctggctaaagttttgtattattagtagagatggggtttcaccatgttggccaggctggtctcaaactcctgacctcaggtgatctgcctgcctcagcctcccaaagtgctgggattacaggtgtgagccaccaggtaatgaaattgatgggatgagttttggaagaacaaagaagtagatgtgaagtccttttagtatttgcttgtgatacccaccaaaatgatcatggcaaagcccaggcaacatttcaaagtaaaaaagactatgtctgtttcttcctactttcgagtgcccatccatctctgataaactactgacctcatttgctcataactaccaaatggccagaatcccactgatgcccaaccaccaacagtccacacagatgaagggtctcagtagttctatagttccagtaatttctcagctgtgtcccaagtccctctaggctcaactcacttatacatgactaagtagagaaatactaattcattggggggggggggggcggtaacaggagaaattaagcgaaatgccacataaaaaattattacagtggctggcacataaaaggcattcaattatcagctattgttttcatatgcccaacatgtagcttggagtacttgctctatacctgtcacttcgctattgtgtgaaccaaagagacacagttcttggcctcatgaaatctaaaattttgtggaggaaataagacattaatacacaattgcaaaacttcataagcacaaactctgcaaattggtaagaagaaaaatacataatactatgagagtaacagtgagggatcaagggtgagacctaaagagtgagcagcagttaactaggtgtagagttgctccagagaaaggaggcaggacagatgaaaagtcagaagcgggaaagagctccatacatccaaaagactgaaaagcgagaaatgcaaatcaaaatcacaatgagataccatctcacaccagtcagaatggctattattaaaaagtcaaaaaataatagatgctgacgaggctgtgaagaaaaaggaatgcttatacactgttggtgggaatccaaattagttcagccactgtggaaaaaagtttggtgatttctcaaagaactaaaaatagaactaccattaaaaccagcaatcaccttactgggtatatatccaaaggaaaataaattattctaccaaaagacacatgcacttgtaggtttatcacagcactgctctcagtagcaaagacatggaatcaacctacctgcccatcaatggtggattggataaagaaactgtggtacacatatgccatggaacactacacagccataaaaaagaataaaatcatgttctttgcagccacatgggtgctgctggaggccattatcttaaacaaattaacacaggaacagaaaactaaatactacatgttctcacttataagtggaggtaagcgttgggtacacatggacatagaaatgaaaataacacactagagactgctagagacggaaagaagggatgaaggcaagggctgaagagctacctattgggtgctatgctcactacctgggtgaaaggattcactcatatcccaaacctcagcgttatgtaatacttacatgtaaccagcctgcacatgtaccatctgaatataaatgaaaagttgaaattatattttttaaaaaagactgaaaagcaacaggaatgcccacattgctgaatctggaggagagaggtaagaggcagggctagaaaggcgggcaagagagcagattaggaagactatgtaaaaacaatgagatttttgtcatgataatgaaagtaagccactaaggggaaatgaaagagggaaattacacagccaactcatatttttcagagtgctctggctgcagtgggggagaatggagtagatgagggtaagcacagcaggagaagaataattaagaggcattctatggctgcatagtattccatggtgtatatgtgccacattttcttaatccagtctatcattgttggacatttggcttggttccaagtctttgctattgtgaatagtgccacaataaacatacgtgtgcatgtgtctgtatagcagcatgatttataatcctttgggtatatacccagtaacaggatggctgggtccagatggtatttctagttctagatccctgaggaattgccacactgatgggaggggggagggataggattaggataggattaggagatatacctaatgttaaatgacgagttaatgggtgcagcacaccaacatggcacatgtatacatatgtaactaacctgcacattgtgcacatgtaccctaaaacttaaagtataataaaaaaaaaagaggcattctagtggttcacccaagaggccatgatgcatatattagggtggtgagagaggaaattaaaaaacacatatctgagtaacattcaagaagcagaatagccaggattggataaagtgtcaagaacaaccctgagcaattgagagtggaagatggtgccatgtgctggaatgggaaagctggaagaagagtaagttggccactggcaatggcaggcttggtagggagagagcaagaatagaggattctctctgagttattttagtttaagataactgtacatcatcccagtgcagatttcaagtggacaattacacatataggtctgatccttgggaaaagacaaaacatatttatgagttcaagaaccatcaatagcttcacaactagaaaatgtatgttctccaaaaatcaccaagacagaatgagaagaatcgttatctaaaaatagatgagggtttttttttaattcaagggagtttttaaaatcatatggagcattcaaaaatgtgtttgctaataggaaatgtcatatagagagggaaagactgcagacaagaaagagaaaggaaggagacaattatggactgagatatctgaaaaggaataacagcattaagatgcagagaacatcaggtgggattatctttgggagaaggtaaaacactttgttacaacaggaggaaagaaagagaagaaaggggtgctgcaatttacatatacttgtctcctttaaagaggagcctgaggatacctaaaataccctgcaaaagactatgaacttgggacacactttcagttcacctctaaatcatatcatgtaaacattagacttcttctgctaataaccaatagaaatcagggatgatctctactataaaactctgtgtgtaaaaatatatctatctggccaggcatggtgactcatgcctgtaatcgaagcactttgggaggccgaggcaggttgatcactgaggtcaggagctcgagactagtctggccaacatggtgaaaccccatctctacttctctactaaaaaaatgaaaaatattagccaggcatggtggctcattcctgtaatcccagatacttgggaggctgaggcaggagaattacttgaacccgggaggcagaggttgcagtgagccgaaatcatgccactacactccagcctgggcaacagagcgagactctgtctcaaaaaaaaaaaaaaaaaaaaaatatatatatatatatatatatgtatatgtgtgtgtgtgtgtgtgtgtgtgtgtgtgtgtgtgtatccatctatatgagcatctggcttaatgtctacttaaaaaactttattaccttaacaccatctgaacaggattcttttaaaagtaactaatgagaattaatacgtaagaatgagtgactgctgtataaatacataaaatagttaatgaaattaatgcacatgcatctagacatccatatatcaagccaagcatgtattttacatatggagtctttgtatccatccattcattctcgaatagagactagttctatattacaacatggatgaaacttgagaacatcatgcagggtgagaaacttcactgtatgattccttttacatgaaatgtctagagtaggaaaatctgtagagatggaaagtagattaatggttgcctgtggctgggggagattgcggactagggagttatagcctaaggggtatggggtttctttggggggtaatcaaatgttccaaaattaattacagtaatcgcatgtctctgtaaaaaccacgaattgtacaatttaaaaggatgaattttatggtatgtgaattatatctcaataaatctcttaaaaattaaagtactttttgtactaatatggaataatcatatctttctatactaatatggaataattacatggaataataatagcttttaaagcaaggcacacatagtgtacaatttgtaatatttatacaaagggagtgaataaaaataaatgtagtgtgtgttttttttaatttttgcatatgcagcacagaatatctttcgaaagataccaaaggaaggaaccagtaacactgccatcttcaggaaatgaaactggctggctggaagacatgggtgaagggaaaattttcaatgagcaatctttttctctttgaattttgaacaaagtaaatacactactttaaaatcttttaaaaaattgaaattaaaattaaaagtagagactagtcataattttatttgaaatgcaaattaaaaaagaatctctcacacacacacacacatttgcatgtgtgtgtgtttatgtatgtgtgtcttttagtccttgtcagacatgtaatttttttctgctgacaggaatataagaaatatgagcaagagaataagctgtgcagacttcttatttgacctggctttgacttcctgtttctaatgtcccttaatttacattttgataggtaatgttcctttctcattttatcttcatatttgcaatttttacatttggatatttatggaatgtggatctacgcaaaatttgactctgccattggaattggagttcagtatgatgtttcaatttattctgacttcagtttttgcttgctaagttaatattaggacaagatcaaactccattaccttgcatagattactctctagaaagttctccctattgccactttgctggtccataatcactggagacaacttcctgaaatatggatttatgggaaggcaaacaaagaattataaacacaaagaaaatcagaaaactatgaaagagatatactgaataatcaataatcaattcaatatcccaagaactaatactcaaagatacaaaataaagcaaatggaaaatttagcttaagcatattcccaaacacactttaaaaacacagaatattttagaagcatacaaaaatagtttcttgtatttccttttgattcctttatatttaatataagactctagttcgtctggcatggcatgacttgggaacacaacagaattttttttagcatgtgggtagacaactattccaacataatttactgaaacgtagtattttcccactgttttgaaatgccatcttaattactaagtacattcttttatatccatgggtctgtttctggactctattttgtctcattcactttcctctcctgcctcttcctatgacaatatcataccagctttatctagaccaatcctccccaaaataatgtttttaaaatccttgccagttgtatatttgcttttcctaaaaatattagaatcagcttctcacgttctaattttttttaatctaaatgcaattttaactaggcttacttgaatttataaatccatgtgggggagaatcttttcatcattgtgtcttcctgtatttgtacagcattccacctatttagcaaggttttcagggggtttttcttcacatgacatatgaattttttgtttatatctaggtattttacctttttccatcaaaagtggaatttattgtctattgcattttctaattagtgattgctattatacaggaatgctattgttccttgcatgctagtattgttgccagccattttacttaaatatcttgtattttttttctagaaaaaaaaaaacataggcttaccagtaattgttttcctgcttctttcaagtggctgtgctttctatcctatttttttcatgtactattgcattgtttggtatctccagtaatagaaataagagtaggcattcacgttttattctcgacactaacaggaatgaaattaacctttcacacttaattataatatttcctatggacttcttgtaaacaccttatatccagttaagagaaattcccctatttctgtaataataaattgttgttgagtattaacagatagaaatttatcaaatgcttttaaaaaaattgatttggggtcttggaaaacaccctacaaaattcactcgatactaccatgtaaacactttttcttctaatgggaagcagatgagtttaacatactgtaattgttaactcttgcccttaaccaagggatacaaataatctatgccacattcaagaggaagacagcatattttctacaccaaaagaaaacaacaacaaaaaacaggaaatgccttcaaaaatcttgttttaaatgtctgcttagatttcagatttctttactttagatgcttctataaaataacagagaaattttaccctcagtatcccaagttttccaagacttgtgattgggaaccataataagcctattaatttctgttttggttcatcttctccttcttcagcccactgataccatccttcactctgccccactgccctagaaatagttttctctgctcactcacccttagccacctaaaatatgtgacacttccccatggccctgatgtgccctggaaccttggacagtctgaatatttaagaagcccttactcagataaagacacagagtagtataggcagaagctggcactgcacgtgacaaggggaagaaagacaataaaacttatttagtcattcttggctctttatatatggaatatcgtgcctcattattataaaaagaaagtacaatcttggggaaacagagagacttctaattttgtcttactgaattatgttagattatttttcctgatattctagaactatccttgcattcctgggattaaaccctatttaactataatttgtgattctttggaagcacaggtacattggatttagtaagacttctcctcaatatcaatgagattagcctttaattttcttctttgtgccacctttatctaattatataatcaatcctatagccttaagaatgaattaggaagatttttatttttctccaggttctgaaagagtttataatatggtgattatgtgttccttgaaggtatgttttgcatttttaaagaagtaacccggatgatctcagctataggtaggctatgaattcactttaagatcaactgacctgaaaaaattctcccacttgaacaatgaggcataaatatttttgtcattgtattgtttataaaagtgaaaaaattggggtgaaaatttatgttcatcagtaagatggtaattcaataaattataccacattcctactctgggtaactacactgtcatttaaaaggatgcaggacatttgtcattactgatatgatagtattttgaatatagacttaacttttttgaaagtcacatatgaatacttagaacatatgcttttcattgctgaattaaggaacatcttagcatggcatataagagttctagagtcaaactattgggtccaaatattgtccctctaccaatcacttttatgatctctatttctcagtttcccggctacctgataaagagagatggtaatagtgcttcacagggtgttgtgaggattccaaagtgaattcatccaaaacgctaaggatagaaactgatatgtagtaaaatactcaattaattaatatttttaaagttattcattatataaataaatacacatatttaaaaaaatgtaatcccaactgagaatagcagttatccaggggagggcaaaaagaaagggctaaatggttcttgatattttgctttgtatatttttacattattttgaacagaaaaaaattatgtattatgtttaaaattttttaaagaacaaagttacagaagcctaatactaattgtaaagatgtcagatagccatatataattagatgtctaagacaagaaaggtattggactttcattcaggtacaaagcaacatggaggccagcatggagagagcagcaggaatgagacacacctggatttacatcccgctcggtccctttgtagctgtgggacccagggaatattacttatcctctaagctagggttttaatagctggtaggtccacagacaccctattagagtttcagtaccatttgcaaagttggttcaaaatatagatcactagtaatttagaaacatttccattgacttttatgcatgctaaagtttaagaaacaaaataaagttaagaaaccaaaataaaatacaataaaaattctaagcctcccaaccaactgaatggatcctcctctcagccaaggggattccaaagaaacctgaaaaattagctcaggccacgatgggaaggagtggtcatcagacatacctcattatacattcctgcctttggaatttaggtacaactgaccagcattaacattaaaacagagatattaaaactgacaaacagactattttggagcaataaggtactaaattccaacccaactctagtagagcatcacatgacagatagcaggtcctgaaagtatcaaagtattttaccgcaaaatatatttgtctgtcatattttgaaatggctatgcaaagctgtctcttatgggggaaatttatattctttagagaatcgcattccatctccaggtcttttttagatcctgaagagattagctgagagtctagtacctttcaaatgtctgaataggaaatgtttgccatctattacctctaagggtagtcacctaaagacttcatcttcataataagaaccttggtatgcacaaccctttatcttaacccagacactcctttctattgattccaggtttttagataataatttaactctttcaaccaattgccaatcagaaaatctttgaatccacctatgacctgtaagcctgcttcccacttcaagttgtcctacctttccagagcaaaccaatgtatacctgacatgcattcattgatgtcttatgtctccctaaaacataaaaaaacaagctgtaacccaaccaccttgagcacaagttctcaggacctcctgaggctgtgtcacaggacatggtcctcatattcagctcaaaataaaactcttcaaatattttgaagagtttgacctttttattaacagaactgctctcaattttgatttcttagtgtgtcaaacatggtgccaatgtcacaccatatttataaagctttagtgagataaaataaatatttaatactgtgcctggaacattaaaaaactgaactcatgttattataataacgggtacattgttgctagtactaccactgttatcaccatactctgtaataactgttcctgtgtttaaatgaaggatctgatatttcctcaacatgccatagccttctatggccttatatttatataacttattactttttctggctcaaaaaataaatgtgaatatctctactatttcctacatttttttttactggtaatattttgtggccttctgattttaacttctgaccactattattcaagtaacctgggatcttgaaaaagtaagtgcagtgcttggaactaaaattctggtatggtccttattaacgcaatatgatttgggcttgactgtgatgggagattgtagaaataggataggaaaagaaaagatatcggaatagtagagcttataagaattgtggttaaagttttcctctctgggtgaggcttgtactaagcatggggtggcaaaaactatgttattaataaaatactatattttctaagaacaaaccagccttccccttctctttgttacctgaaaaacctaggcataaagctacatgagtctttggtcctgattctccatttcctttggagggaaaaaaaaagtccacatttctcacacagctttgagggaaagactcataaccatacttaatgtataaaagctgtgatttccatgcaaactgctgctttcccagaaaaatgtaaaagccccctttagcagtttaaaaatcctttaaccatttccttcctgttccacttgaactaggggccagcttgctgtgccttaaagccttccttcagtggctttcagatgaataagttaattttagaagtgttagaaacatttttaattcattcagacttgcaagatatcattaaataccaggtacatacactaggagccaagaagagttactctacgattctctcagtcacagataatttccttaccatactgggatttaggcctagcactgcaaacagcaaaacttgggcttcctcacagtagccaatgtcatagctctaagcctgcaccaatgtttactcatttacactctttcttttatagtttcaccaaaaaagaaaacaaacaaaaacaggtgcatccacactatacaaatgagaaaaggtaacctctgaaaccatttcacagcaaacagaagatccacaagctgctcactagctaaaaccacaggaggtgtgtcaggcaccttgatgctgagccacaggaggcctgcaggcttggaaggcagtaaatccccagagagctctaaactcctgattggcaagccacaccaggcccatcagctcctcaggtgctgagccacaggaggcctgtcaactgctcaggtggaaggtgtgggaggagggaggaggcaagctgtgtggaggagcttgaatgaaaggccaccggctcaccaggggagacaggaaatgagaggtgcctactgggaatactagagttcagagaacttcatcaagaaaaggaacgaacccaccccctccttgcatcttcttacctgcagggaagcacatctcacagagagtacatttctggcccagggattctaaataaataaatgctaatgtagaatgattcccagattgagttctgcagcagaccaccaggtcttccagagaaaatcagcacctctttgtcagttgctaaggttctcagggaacggccaccctccatccaccctttgtttgccaagattctcagtatgacagtgacacagtgacatctcccccttaagtttccaaaagtcctggaaatactttagtagggactgactagtcagtgactgcatctcactctttcatttatttactctagcatttgttgtggctataagccaaatcctctgctttgcattagagatataaaaagtcaaataagacataacctctgttctcgaggtgacataaaagtaagtaatatttacagaataagggtatatgacagaaatatatccaaggtgttgtaggaacccagcggaaggagaattaaatcaaatgaggattcggggacactttctagaagaggtgccaccaagttgagtgttaaaggacaaaaataaataagctgaaagagaggtttagggtggggagggagagaaagggaaagaaaggagaagtggaaaaagttacaggtagtaagaagagcaagtaaaaataactggaaaagaaatagtcgattccatccaagaagaatgagtagataagtagaactggacaacaatgcatgcaggagaacagcagacgatgaggccagatcacaaagggctctgcagtccaaacaaatacgtttgaaatcgactctgaaagcttcaggaagcccccaagtatcatgcaacatcgatatccaagaccaaggcctcagaaaaattaaagcctgctgattttgaaaattgggtttctcaggtttctgtaaaggttaacttatttccaactaaataagaaaaaaacaagattatttcagattcatagtcagccttagctctggttcctgaagtaaaatttctcactttatattttgccacttggttgttaaatcttttgtgaaaccatatacatatatgatcatgtatagcatatatagcacatattttactaatatgtctttaaaaaaggatgcttgccatagtaaataaacagtaatatgatattaaaactcaagtaagtgccaaatattccttttctggaagggtaaaattttaaccatatattcccaatatgatttactttctcataaatgtattaataaattgctaattacacatatgtagtgcaatactaatgtaataaatattatctacatagtaaaacatagaaaaagaaaattttcaaggaatagaataaaaataaggaaaaataaaggttttgacattttctatttgttcttcagtaagtcatcattcaaacctatgttggaagccccctacttacttagacagctaagacagatctacacccccatgcctctgtgctctgtgcaattgcatgtagatgtctgtacacctttcattaaaccaaatcaactaaaggaagaggaaaagagataaggagagtggtgaggtaacacacctgtggtgggctttgtagccaataagaagctgaggcaatagagctggatgggagaagacacctgttaaatgaagtttagcctgaagctgcctccttacatattttaagtctggcttaaaggcttctctgcatatagttaattgtaacctaactagatatgtaaacagactgtaacctactcttgtgccaatcacagagtttcagccagtcaaaggcgaccaactgatcaaactgtgtgcaaaaaaggcaaatgctaagctgtaaccaatctggccatttctgtacctcattcctattttctgtatatcactttcctttttctgtccataaatcctctgccacatggctgcacgagagcctctttgagcctactgtggctcaggaggctgcccaatttgcaaacggttctttgctcaattaaactctgttaaatttaatttgtcttaaggtttttctttgaaaatacccttccctccactccctggggtcaatgtgagggtgaaggaaaacataaattatgaaccaagctcttgaccctctttgtagtacatgaaaagcaacctggggtgaaggcagggatagatacaggacgttttatccgaggagcaagagagagtcatggggcttccaggatagccttggccccagaagttctttcccatattaccagaactctgggatcttagggacagacttgttttttgaggggttttttttcccatttttctctaggagcatttagaagtcagcaatttgggaaccactctacataaggtatgtgcctctatttccttactacaggtgatcttgctaaatgtaaaccctattcacaaaatgtgtgtcatcataggatcttgcccacttctcttttccgcaggatttagtaagaaaaaaaaatgctattgtggtgaagattggaattatcaatacctcaacctatgggaggaaactctgctgtagacacccatccccctagatttctcaagaagaaggagctgccacacactacttcctgccctatgatatactgaggggagagggaaggggactggtgtgtcagtttcagagttttgattcaggactacagccgtgtccccagagcaaacaccccaaggcattcagcctcactatgccaacagcaatcattcctgctgatccaacacacgttcaccgattatgaatgaatgagagcggctgggatttaatcagcactctattcaatccaccatgcctccatccattcattcactcactcgctcactcctctaacaaataaacaaagaacttctactcttctggagcttccctggacacaggaagcacaaagatgagaaggccccattggtgccaataacattctggaagacagcagagaagtgcctgccatttgcaccccttgctgaccacagcccagacagcctgggcagagtgcagaacattcaccacctccgtgcgtgggctatacagacaccatctctccacacactactgctgcctgaaaaatgcagtcagatgggttgtcattaagcctgacaaaaacccagcaccatctaggtaagagcaatgttttttatccagacactaaattgcaatcaggttacgttatcatgtaaataaagaggcaaacagatggtttcaaacgagatccagggctttcagagcattgccgatgttacaaatgaagaaaagcaaggacaagccattagacacagagcgggccccggagtgcacagcagcccaacaaacagaatcctggcctggataatgcagccaaaacaaaaggcagtcacttactgcttgcaattgtttgttaatcaaataccactaatttccaaatctgggcaaatgctctgagaaacatatattcatactttttccataaaatatattttgcaacggtgtcatctgtgtatatcaccatgacccttaataacacagctttttaaaggctctgttttatttcctcccacatgtttaaataggaacagtgtaatgaactagacagactcagggaatccagaggcctagatttgactctactgtctctgttatctctgagctctttcttgggcatgccctcttgcgatcatttccctcaactgtaaaatgtgaaaacaaaaaatgtggccgaggccattagctgcttcccagtatttattttatcctcccttagtaataagaactccaatttttagctgaatagtttgtcacctagccaaaagactacatttcccagcttcctttccaggtagaagtggccacgtggctaagtttacactattaagatgtaaacagaagtgtcatgtgagaaataaaagaagaatcctttctcctttctgctgcctggaatgcggctgcaatggctggtgctccagcacattgatggaccaccgagtgactttggaaatagaaaaaacactggaggacaaaaaggtagaaggggtccaagtccctgacaccatggaacagatttttatgtaagagagatgtaaactgacatatctatcaacctcgtaccataataacaatttttaataaaaataataattttcagggtttttttattcacagaagacttaatcttcctaatacctggatacccaaacccctaattcttaatacctggacaacaaaactcccagaatggtcgtgagtgttaaattaggtgtgagaactctttgtactcaaaatgtttccctgaatcctcagcatgataagctgctctgtgaataaaagtgttacacgatcaaacatgctggagaacagctggtactatatccccctccgaaagttatacaacccatattgtcatataaaaggatttgaaaagaccagaaacaaaaaaaagtatttatctgtgcttagtccaaaatttttcaaatttgtttgacttacttttttttccatgtgatgcttacagggagctagtttcagaggaaacactttgagaaatcctgggtaaatttcttaccagtaatagctaatatctaaattgttgcttttagccttcaaatatgaattgtaattgaatttacttctatgccagtccaggtccaggtcttacagtatatgctttcattactctctgaatgtttcctatagcacatttgttagtcgtattcatttttaactacatgcaattacatttctatctccccagctaggcagtatgttccaggtgggtctcagaactattttgctcatcattttatctccaacatgaggcaaagtggcacataataagttatgcacccagtaaatagttgctgaataaatgcatgatttctgaactctgttttcatatcacacattatgcaaacagcagtgatggaatacatgtaaatcaattttggctttgcgaggggttttaatctcttttagctctcttggatggcatttggaccattagctccaccagtgcctatgtatatactcttaatgaactgaacgttagaatgtcccttctaagtatcattatttagtaaacataagaaatcctgagtaacattgacctaaaaataaaataggagatttttaacgtacttgcagataaagaaaatatcagaattctcaccaagacccattactgggttcaactggtctggatatccaagatagatcacttacatagctggaagctgagattggctcttggctacagcttatctccatctggggctgccaagcagtgcacaaaaatgacctttccatatgatttagattcccatagcctaaggtatgtgttccaaaaggaaacaccccaatggcaaatgagacttctaggcaaaaggatcttctaatgcaagggttcttgtgacctagccttcaaaatccaagaacattattctattaatacagtctgtcagtccatctagtcacaaaggccagcacagattccaggggagggcaggaagctctatgtccctatagaaggagcagcaagcatttataggaaggaacaaaatttatggtagccctttttggagaatttctgcaataatgacattgaaactacgatacctattagaaccagtgctaggtactgttactcaaccttctaacagaggagcatattatatcacattttattttaatattttgataaccataacaatataactgatttcttttataatcctactttattttatgtatcaaaaaaattatttagagaatgggtctaggctttaccagactgccaaagggatctgggacatataaaatgttaagaacccttgagctgcttaatagtgtggtaacctaagggtcagcaatgagccaactatgccattcctgcccctgctggcctgcctgtacctacaaagaccttgtcacttcagcaaagttcttatctctaaacctctgtacatgaggaaactccaaaagctccctcaagggagtataatcaactcaagaaatggcaactgtacctaaaccaatgattgggaaatcatgaattatttaattttacattccaaaaatatctgcatggaaaacagaccataaagagaaaaaaagtaattcaatgagaacacgtgaaaaaagccctgctctgcattaaaaactcccacgggcagctgctccttgcttggcttgtacttcccaaccccaaccaggggggtaaaatacatatgcaatcactcagtttcccttcttttgtaagaaaggccttggtaacactcctcaaagaatattaattccatgagacaaagttcttagggcaataaaactaggtaaaatatgtttatgcattttaatcaggggaaatttttattaaccctcagcaaacttgttgcagtgcaaatcatagaatatggggttggcacaaactttaatggtgatttcttagtagggtgacccaatcattctggtttgcctcagacttcccaggttttatcactgaaagtcctatgtcccaggaaacaccctcagtcctggataaaccagggtagcaggtcattctctttaccaatgattttaaagacattagttcctgatatttatgtctccaaataaatattaaaacctatggatgccactgtcggtattccagaactgaaaggaattaaccaattagctctgatagagtaatgttgcctgttttaaataacatggacttcaattcttacctccaggattgaactcattctaagagttatacataatctcctaaattttaaaacaaaatatattttgtattgtgttgtgtttttgtaatactctacttttaggaaatgacagggattcagtgatttcattttttgtttgtttgtttgtttgttttttgagacggagtctcgctctgtcacccaggctgaagcgctccacctcctgggttcaagtgattctcatgcctcagcctcccaagtagctgggattacaggcgcacaccaccacaccaggctaatttttgtatttttagtagagacagggtttcaccatgttggccaggctggtctcaaactcctgacctcaagtgatccgcctgcctcggactcccaaagtgctgggattacaggcgtgagccactccacctggctgacagtaattccttaaatgacataacctattctattttccaaatcaagctgattgagctatacacattaaccagtttggtgggactgagcctattacctgagcctattaatttagaacaccgggcagtactgtaaccagaaagtgaccagggacacaacctggctgccaccttaaaagtctgctcatgggcagtaatggtttttaattttaacaaagatatgggtatccttgaagacaccgatacaatccagatgtgtgaaactataaaacaagcaagagatgttacattagattttgcatttaattagtgggagcctgcacagaggatatagtttattctcaagcaatttccaaattaccatcctccttgtcctccttggaaaatttactgttaaccacctccatcatcgtggtattgctcctttcctgccttgccttctgctgtcctggttctaatttcatgactactcgttctatgatatctcttcctgaaacttaaattagcattgccctaagatgctgacttctacccaatccttatatctctctgcaatagctctcatatgagtcctaacccccattcaatactcaaggcttccttagtcaattcttctgagaattaccaaattgcaatccagattctcaattggccttcctttcaatcttctggtccacatttcccgttaccatctaggcatctgcacatgaacctgagtatatgactataatggaatttattatcctccctgctaaacctactcctttacatgcatcctctatttctattgatggtacccctaggcattcacctgtgtgcaaaagttctggtcatcttctcagctcatttttctttatttttttacaatcgataaattgttaaccctatcaattctgctttcccatcaagtttatggtacttattatatttttccatagcagccatcattgcatttactgctactatatagcttgtaatttgtattgttaaggtcaaagtatacttgaaatcctggggaaagtaatgcatagtttctttaagaaatagttgtaaactgctgctgaaagtttgtacaggttaagtaagagaaagaagttgctatagtagcaaaaaaaaaaaaaaattatacctattgcaactaaaggaaagcatcataggtgttttacaggaatacctgctagaatcctctcaggctacaacagaaggtgcccaatacggtcacacctctgggagactgaggtggagtatttgaaatcataaaagtagttattctctagatgggagcacataccaaaataaaacccgagtctcttatatacttcatgcttgccaattaccgccaccccatgatctttacatcctggggacgtgtgcccctcctagaaaattactatgatccatgatgctaatgctaatggaccatgacaatgagtgtgtttctcaggtgagtgaaaacaagaaaaggtttgtaaaagtcctctattagagtaaaactcgaattagttccagcaagttagcaagccataaagagtgtcaaggcctacctgactttggatcccaagagtagaccctaagtgagttctaattagccagaaacaaatgccatgactgattcaagcagacatggacaaattaagattggaaaaagaatctcaacctatttcaatatatttatatttttatgtttattctgtcacagggaaaaatgcactgctattttaatcgaaatttcatttttatgaagaaaagcatatatagttgagggaaaaattctttttaattcccactcctaattgtccaccctggcaaaagcactgtgtcacagatcttggttagaaagtttaggggactgctgctactcatttgggagcatccgtttgaatcgtggtcattgcaactagaaggaactccctagcctcaaagtgttttgtctcaaaattcaatcctattttaggaacaaaacaaataaatcaatagtagtccctttaataaattttaggggtcaacttaaaacactgggttgaagcatggggactaaaatttcactcagctttggtataaaacatcatataagtttgggcaataatcttaacatatgtcatagcattttacaatttataaaacacattattatttagattattattagttggattagaaagccactacatttcctgccaaatcaacaattctatgtgtctataatttacatatatattaatatttataagtaaatccacctcaaaagaaaacaaataaattactaggtaatcagttcatcaagggactccatatagcaaagcactttatacttagactgctttaaattgtaagtttctatagtatatttttaaatgatttgatatatgaaaagtttatttacattcatcatttcaaagataaactgcttggggatgttggtgagaacacctgctctgtggagtctgaaattcttccttccagtggtgaggacacgactttgacatccttaaagcaaggttcactaaggtctatgattctctctaagaaattgcctaaaaggaaggagaaatagacagtttccaaagatcctttcatctttgacttcaggttttctttttatttatttttattggaaaataatgttgattaaagtttttaggtcaaaagtagcttaaagaacagcttttccattcactttctaaagaaggtcaaaggaaagttcaactgttgtctccctggatctttaatgtctaccctgaaagaaaatgctcgaaatatgtttccttcatgtctttcctcatcccaccatatccctctcttctaagaagaggctctggtcacacatgtaaagatttgaccacaagttgcagttcaacaactaccgtccattcccactgcaaagtgagcaattccaaattgggggcccaattatgtttggagagttgacaaataccactttcaggcagagaagaggtggtgtaattaacactaagcattataggtaaaaataaaataaaataaagaaactaaaaccctttgaatagtctgtctcctggtgttctgtaatttcttattcatgcaagccaacagagtctaaataaagtctgtccagacagggaagacagcacaaatttagcaggctctaaagcactttttgaattaagtcaggtacatctgcttttaattacatacatgcatatatgcttacacacataaacacatacacagaggtagattaaagacagctgcaaattcttagctattcctcctattgagaggtggaacctaattcttctctcctaaatctaggctgacctcaggaccttgcttgaccaagaagttgatggccatgatattctgagcttgccagagccagcttagaaggcatgtggcttccacacaggtctcttggaccacttacttttggaacacctttcttaggctattctttcttggaatccagccatcatgctgtgaggaagcccaagcagccccataataaacccatgaggagaggaactgaggcctcttagttgattatcctaagctcccagccaataaccagcatcaaggcccagccatatgaatgacccatcttaaaggcatctaaaggcagccaaggtgagcctttcaatgaccacagtccagccactatctaactataatgcatggaagaacccaaattagaacacctcggcctcgcctttccccataaaattgtaagcaaaataaaatgtgtgttttatgctgttaggtttctgggtggtttgccaggtaatgatacagtttcagaacacccactccacttgtcaccattctgatgccacacattacaaaaaggaccccagtagctgaagcccaaatttcttcccttcccacttgctaatccagaataagtggggtggtgggctttactgcttttatgtcccatccaaaaggtacaagaccaaaatttgagaactacacaagctatagaaacatcaccaatatttgtttggtttctaattggtgttgtagacctacatctctgctataattcagtatgaaatactgaattacatataatctcagataagaaaaaggtgaatgaagtcaatagttttataatcacaagatttcatagaattcctcccctcaaaaattactttctgatttatgatcatcttgcttcatatcaccaacctattatgatcttttgcaatttaacaaggaggtgcattacatattgccatctttgaacatcacacgactttgataagcttctctggcatttaaggtactgaatattaaaaatcagaacaaacagaagagctattataaaagaaaaacagtactctcccattcatgtcttcaaataaggacagttcaaagtaatatacaaaatgtaacagtgaattctaccacacacataaacacacaaagatgctggaggctacatgatatcatatttgcacccttcaaaacagaatcctgagaaagcactggaggcatcttacacaaatccactctggtcagtttagaacaaggcatagagcagaagctagagggatcttttgccatttgaccagctattctttatgaaggtttgagatttgcgtagtaaggcagaacttgttcctactacttaagaagttgagaatgcattcaggccaatttttccaatatttagaaagcaaagacagtcagatacacttacttgttgaagcaaagttatcacgaacttaaactacaagagcaaattcttaatgattacctcagcttactccatataataccacagagaagaatttacagttctttcaaaatccaatgtccataaagatagaacgccttgaaggaaaatggtaccatacttaagatagtgatgtcttttattagtacagtaaagtcctatttttatggaataggatgggtctgaggtcattccataaaattgatttcccagaaaatggaaataggcaatttaccctaagaattttattgaaaaattatgctattctatttgaataatgatgggaatgttctacacgtttcctttattaatgaattaaaatacacaaaacaccataaaattatattagaggttcaaaagtatcacttaaatcttttttaccagtcactttcattttgtaaaatcagcagttccattaaaatcgtattatgtaaaaatgggtttttactgtaataatagttattacctatttagctcccaaggatgttgtgaaaattaaataataagccattggaaagcaaatacaaagtgttgctaataccagaggccaagaggggcagccagatggaaaaatgaaggaaaagagcacctgatacattacaaatcacagctttcatctgtaattccattaccgccaaaactctatgcgttggtcatgtgcactgatgttatctcatttcatctttcttaacattatattaattatagccctaatgttataaataaaggtcagaaaggtttacagcttgtccaatgtcacaccgttgtaaatgtcagaagccaaatgtgaaccccaggtttatcctagtcgacagctcatcctatatcctgaaggatccccaatatacccttgtgtctcataactgcccctctaattcttacctcatctttcaaaattcacttcaaatgcctcttcttccatgaagccacctttaccctagagacactatgattctaaacacattcagtatttattatggctatttgttgtattattgtgcattatgtgttttattaacccagcaaaatccctggctggtcacagttgtatggaacttgactttgggttcccagatcatgagcgcttggaactgtgccttgaacagagtgaatgtttggtaaatatttgctaaactgaactggaaaggggtgttcatttgaattacaactacatctgctaccagatgcaaagcaaatgcttttactaatggttcattgcattagaatggttctaatgcaatggttcattgcattgcatacctctttgggaagtatctccagtttttccaagcatgtgtgataagattaaatacctcaagcagtgtatctgacatacaggagatactcaacaaataatagttttttattttatttttgttttatttcaagttaagaatgcggatggtaagagaagaatgtggaggggcataaattcagtataatatatagtctaatttggagatatcagagcaggtattgatggtaagtttttttgaaaaaagaaagatacaatgaagagttagaactcttgatttaaattctctgatttcctgcaaagcttctttacttactggctgggtaaaacttgagcaagttaccctctctgcatcccagatttttcatctgtaaaaacagggataataacagaatccacttatagagtggtagtgagaattatatgaaaaaaaaatccttgtaaaatacttagtatggtgcatgtcacacaccaagcactcaagttatagttgctactatcaccatcattactatcatcgtaaaaatcatttcataattcttaggaatctattcaaaggagaagacatttttttccacagactgtaaaatcctatagtggtatgtgtcaatgctgtcaaacacaaagatttatttctgctattgaattatggatgggagcaatgagttcatgcacttcatccaaatgatgcttactgaacgtctactttgcgccagagtcaggtggacaaatttatttgatttaaagaaggctaggaatgaaagaaacaaggggagccaggaaaaggtggagagttcagagagagacaaaaccacaagcagaaaacaaaggtagattcaatccagagacccatcagaggtcaaaatatcagcctgtcaaaaatcagaagggaagagtaaggccaagcagctcctgcataagaccccaatccaaatggcacaatgaattcaatcgctcatcaatcacagatcattttttggagatagaagaggggttattagacaacaggagagggacaatgagcaaggattttattttttatatattacacacctgtttttcactcacctgtcttttcatgtgaaggctagaaataatgaaaaataactgtgtatgttttaaaattcttaacttttctgattatcacaataacactgaaaggccaactggaaagtcctttctacatccaatgcctgtgccccacctcctttcccccacccagcattgatttgtgctatttaagagcagcttcacggagaattcaggcccatcctatgatcttatgagctgaccatagacaaaggaatgaagaatagtggagaaagccagggatcccgggacccaggacacacagtggacacagtcaactgcagtgccaagcaaaatggccaagattgctccttgctcggcataaaaaccccaaaggatactaaaagcttggcaaccttcaaaagcttctcttgcttcctgcatggggtgggggaagcagcttgcttagtgggaaaaaccatagcccagggtgaatccgctggctagattcatcaaagagatggctgagacagaacagatttttccttttcatataggaatgactcacgagcttgtttattcaaaaagttacatcctccatcaaagagaggtggtttactgggaagtgggatgataataataattgacgtttgtactggtcagcccactcacacctgtccctcgtgtctctgggcacagttacacaaacacaccaccaatgataagaaggtggccagtatatcttctttcattcttccttcattctgccacacaaataaagcaaacaatacagtgaccctcctttattttactcgtagtcattttagaaagggaatgtgcgttattggttcaagatgaggactggaagaaagactgcttgggttcaaattttgactctgcaaattgcaaaccgtgggaccctgaacaagtgacttaattgtcctgggcctctgtttctctgtctgtaaaagtggggataataatattacttatttcataaggttattgtgaggattaaattagttggtacatggaaaacagttcccggcacattgttagttctcagtaaatgtttgacattatcattattattacttcacagatggttaaatgttcttccattatggatcttcttttattcactattatcttaagaggttcaaattaaaccataaatgtaattaggtctttgggggaaaatataattgtcctatgaaaaacattttcttctcaggctagggagatattctggaacttttgaaaactctcctttaaataagaagattttataagtatggctgtgtgtttctgtatatctaaggaatcatcttttttataacgtgtatactggaagataggtctagacaaacagatgaatagatacatagataggtatttttctattttattaacctacttctcggcaattttcaaaactcatagcaaccgaagagcttgtcatttttcctcagtcctgtatttcaaaattcccaaaggcaaaccatcagaatgcattaataaattgttgtcttccataccctctgtgtctttcaaacttaaggatactagaacctgtaaatccattctctgacacatgaagaaaattaaccagttagtggattattttaactcctttcagcatgacaattacttattccacttttaatgaagatatgctaggttaattttggggggatttcactggtctatgaaattgttctcctacattaacccccccaaaaagaggaagaatgaaacaacataagtgcctacttatttccaaactctttactgtgttgtacaatataaatgaaacataatcagatctggctgggttcagcctgtctgtgattcatctcttgggtagttttactcactgggtaaaatgagaacgtcatccccagggcctggaatggtattgttgtatcctccccagccttcttcaacaccttgccatgtttcagggagggaccattttaaagctgattcaggggcagaggtagaagctagaaaataaaaaaaaattttgaaaatctaatccattgtgataacttccaaattctatccttattttaggatgctagtggtattttcacctcccaaagaagctgcctatcaatattttataagtttctgtacaaatatttatcagttaaaaagcaagtaattattcaatccttagattaccttcacttctgaaaaaaatcccacttttgttattatacatctgttttgccttataataaatatggcatgcttatcatgaaatatttaaaaaatgcaaataagaaaggtaataattgcccataatctcactaccttgcaataactaccttttatttctgtttccttccagaatttctcagaatttttacataattgagattatatcaaatcctgttcttattttttacacccagttctacttttgcttagcttagcctattttcctatgcattttataatattatttaaatgccttgtaaacataattttagtggctacatatcatattttaaaaatccataattaattcctaatgtctgacattgagactctttctattctctgttaaattgtaaataatgcagtgttaactgtctctatgcaaatttctcaataaccctgattatcttcttcaaatacattcctcaatggaatgactgagtcaaaggtgatgttcttcccacagctctccctacacattaaaggcggggtaataatctaaaaacttctcagggtggtaacttacagacagatcataccttccaaccagtttctattgattctgcctttgatcgtcaaacggcattttcttttcaaccattctgctagtatctcatcgcataattgaaatgtaaatctaataatttccaatggggactgtccaatagcacatcacgcacaacaccatgctgaaccatatctacttgttctttcctgggatgtgattactggtacagagttagaagggaagagagattgtctcaaaagggtagaatgaaaaggcctcctcttttgaggggagggagggaatcatgtccatgatttgctaattttacaacataaatagtgagcaccttctctattagaactgcccttaaaaagtagggatacaaaaagaaataacatgtcacccttgcctccaaggagctgatagtgttatatcagtattaggaggataaaaactctacacaggcactgaggggagttctttttaatggtacctgatcacgaaaggaagcaagattttgccaggagaagcttcccgagggaagtagtaactcagctgcattttaaagccttagaagttattcaggtaaaggggaggttgtgatgagtgtatgacaagagggttgcactgcagacagaaggatgagcatgagccgaggcaaaaattgggaagtcaagtggaggaatgataagaaatttggtgttgctgaaccacagagctagaagagaggtaagtgacaaggttggtaaaataaacagaggccagagtatgaaagataataaaggtggagggtccagagacttccagcacattaagacagaagtggatgaatagtttgtgccatagggcattcagggtatctctgtggtctccagatggagctatacagcaagcagtggaaaaatatgaattggaaagatgggaagagctctgagcccagagatgaatttggcatcatcggcctagaagctgtatttgaaactctgagggtggttgtaatagctccagaggatttcaaggtgacaagggaaaatacctgatatcagaaacatgaggaacacttagttattttttctaccagacccaattcctcagtagtcatggtttaattagagacccaggataacctaaaagtatatagattgtggtcaagcaaaaaccataggcaacttaattagtacaaaatataccacacaccttgggaataaggcaatgtcttggaataagcatcactcagtaagaggctttataaatatttcataaactccaatactgtaatacctttctaagttttttcccaatgttgcctgcttcccaacattagacccaaaatactcagctgggggtagagtaaggggtatttgtcagggtgacccctagcttgccccacaaagtccagataaaatgtctctgatgcctcatttccagtgatatttcaaacaagcaatgattgttctctaaaacctcacgccaagcttcaggaatctttagttactccaattttatatcacagatgatggaaacaaacattctgtacttttttcacctttactcttgcttataagagggctgacacagtctttagttggacaaattaggccttaaggtagctattctaatgaaggaatgttattatgtacaaatttaattattctataccatcctgcttaagataagaacactaagggataagaaaacatgtttcagtctcctgtcagagttatcagatttctatacaactaatatcagggttctatatgactattattgacaatcaaatttgtggagagaaaaagaagcctacaagagttaaagaagcagcagtcagagatctactgggagaatcagaagagaggaaggtcttggaatcctaagtaatacagcatctccagagagcacaagtgaccttgttaatagtagagttctggtaagagagagaattagaagtcactgttaaacttagcaatcaaggcatgggtgatccagatgacagtggtcccagttgagtggttgagacagaaaccatattacagtggattgaggaatgcactggaggtaaggaaggaaagatgttgggtcagaccatccaaaaagctcactgaggaatggacagtcttaagagttgagaaccacagcctttgatctgtcttctgaagctttagataaattagactagtttcaaaactggagcccatgaattttggtctggaccaacactcctgatgaggcctctccttgcttccctgtacaaatttgtccctcaacaagcacttaagattttaggtagtctcaagtctaatacatgagccaaatgttggcctccacacctttgctcttcatcaacccaggttttcatggctctgcatgaagaggaggctaggcttttgagaagtttgcaggacagctgtctgctaaaggaaaattcagtatccacaaatttgttttgtttttaaatgggaggcactgaacagaagaagccagtaaggaaagaaaggttaactacacgagacaatgagttgttcgctgatgggggaaagtgtggaagatgcaggaagggatgagttaactttgaacaagactagggctgcctgattctcagagatcaaagaaagcgacaaaaacttaggtctgtgggaaaatttaggaaaagaatacccgatgatctggatgttcttatatgaccatggacaatatgtgcacttagtacgggtacatattacatactcatatcggttaacacatagatagatggttaactcattcaaacattggattgacccattcaaacaatggaatgaatgagttaacacagatagatgtgttaactcattcattcattcattcttagttttggcaaaaacgatattgcaataattttactgttttacgtagagctactcattaaacaaaatacattaccatatttaaattttggcactagcacagatactacatacatgagaatcaggcaatgtcttgaaagtatgttatttaaaatttcctcctgatgaaggatattgtactaaatctgtaactctttgtgttttgaaatagttttctgttcccaactatatgaggtaggaaaactggctagattttaatataactcataaattaatctatgctcaataaggcaatttaaacacattagaggctacattgtatagcacaaggaacactgggctgagttgagacatctgagttcctatctaggctcatatgactgactactgatatgactaagtttaatatctgggcttcacatccccatttgtaaaatgaggcaactggataggatagcctgcaaggtctccacctttgttaaaacccacaactctatgaagtatgggctttctatttctcagcagttgtaattgacagttgtaatgcaagcatctccagttaaactgaccccttctaaaaagctctgaatgttccttccagagaatccttagtacagaaatcatcatactacatgctgagtgacatgccaccctgactacagatggttgaaccaagaatggccattcatagatggtccagtatccacagaagggggcctggcatgagagcttccccaacaggtgtgtcctctacagaataggcactgacacagcaaatcaaatctctccttggagaatttgaacatagaaactttcaaagaagagaaaactatccttttccttataacagtaatttttaaacaactgtattaattgattacttagtagtttgactgacatccccaagagatcataagaccccataaagtcaaagttcattccatcttgctcatcatggtatcccccacaccttgcataaaaggcactcaataaacaaggcattttgaaccacctaaaggcaaagagagatgaaggacaaggaacataaaaaacaaagtgtggtggcagctcagaaaacattctgaaaacaatcttgaatcacattcttcatagtccaataagcatggagtagtaaccttcaggattatcatttatagttttagtccagtcctcttacctcatttacctattaatttaaacagaggaattagatcattttctgattagcatgggctctgctctgacatagcacaaaaatgccactgaaaattaaaagaaatctctgcgtttgaaaagatttattcctcttgcaaatgtatagttaaattgactcagaataaacaaaaacaaacaatgaaatacatcagaaggtgcttaggagacatttagtttttgagaatttggctttttgagttagaaagatttcatagaaccatctgacttttgaggagggtttgtttaccctgatttcctgaaattaccaggaacaattaaagtttagagataccctgaatttttctttccatttggagggggcctaatagcccatctgcagatctggagtcctatgtgcacatatggtccataatttatgaaatgtgcttatttacatgtttcaattcttactttcattgctttgaaaaataaatccacctttatatccttttttgacatgcagatacatattttagttacagggcaacacaatagagagttatcagacatataagctttaggactgatacctgcctgtttattaacagtatgacaaggtggaatttgtagaactactggaggacattctgccatactagacacttctacttcgtgtgttaatactcacctgaaatagttgggggcataccttccttcacccggagaatgacttgaacttggccttcacctgaaactaaataccaaaagccacaacttgcatgtgatacaaagatcatcttaatattaaagacagtcacacgtgagaaaagaagaatttatgctaaattctagttgcctaaattttcaaaacagaaaaatgaaatccttgttagttaatctaacaattgatttccaacatttgattttgattgctttcatttgattaaatgtaattgcaatgaggtctccaggagaactggcacataaataattaggagaaacaaaaacagaaacgaaacctttagccatatgttctaaggaagccaatggtgtccagcagggcatatacctcatatcctattttctcttcatcattttgtaggctcagcttttagaattcatgtgtttttcaccaatagagttcagatcatccatgaaatgtatttggttacctttatccaaacaaattgtccttttaatgaagccttttccccaccccctatcctcctcctatcatccaagccaactgagcacatttaaaaggcctggggttcattaattttaagcgttcaataaattagtggaaataatcaaaaggcctgattctttctgataatgacaatttgatgtcaggataaaccagtagattaagctgggaacatatgctcctttgccaagagaggctgctataattaaatagtgaatgcatctacaaggtgctctcacgcctgattaattagtaatcaggtgcacaaactccatttttcagtcacaccttgtctcttattggttaattacctttctgccttattgtttgtcacatgagccacaccttccaccactggagcaccccttgttgctgaaggctgcagccttggggactcggccaaattcacattctccacttttgttttcctggaaccctaaaccctttcctccatcagatgaaataaacacaggatcattctttctaaatataaaacataagcagccaggcgctgtggctcatgcctgtaatcccagcactttgggaggctgaggtgggtggatcacttgaggtcaggagttcaagaccagcctggccaacatggtaaaacccatctctactaaaaacacaaaaactagccatgcgtactggtgcactcctataatcccagctactagggaagctgaggcaggagaattgcttgaaccctgcagtgtggaggttgcagtgagccaagatcacgccactgcactccagcctgggtgacagagcaagactctgtcttgaaaaaactaaaaaatgaaaaataaaaataaaatataagcctcagaatattacaaagaaaatgatccccaaagagatccatgatgagacctcttcaatttctctaatcttattttggtcattttctctttttaaaatttttctaaggatgtaaagcatgagtttgtgtctttctccttacactgccacatgttgagacctggtacaatgacaacatgctcttgacatgttctacctttatcaccacttccaagactttgcttaaattgttccttcaccctgttgcttatttcatgcatctttctaacttaatactaataataaagccaccagtcaaggtgtcatttcctttttttaaaataaggtctaactcatccacttctgttcacgttgatttgtgcattctctaaagttctaaagtacttctaaatccatcctgtgatattcatcccaaacttgttctcaatttaataaatatttattaagcaccaactgataatttaagatttcatcaataattagctttgtcttcaaatttttgagagagagatttttctcatgcaccttatgagaccagatattgctagaaatgtagatacttcattttcatgggccaatttagaaatcctaggtttaatcttgtatctgtagctctttccactacactgcaccaatggcttctggactgagtggtgaatgattttcttaaacctctacacacgcacaaatggtccctacctccaggagaactccctaccaaaacagacattgcaaaactaaaaaatatattgaaaatctgttgctcacttcattaacgttgagtgtgtgaatgccagtcagtgaagagaagtagtttcaggatcagaacagatacagaaaagttaacaaaagcaggaaaaattagaagtctgatttcctataccaccatctacatgcatctgggggcagatgagtatgagacagagggctatctcttcccaaacaccatttcctggtcatggtcatgacaatagtgaatggtgggaagaatgtgggtgctggagcccaacagcctgaatctgaatcctggctcttctggttcctagacatgggccactgacaagttatttgccatttctaaaccttattcatttcatctaaaagtgggaataatcatactatctatctcatatggctattagaaagaaaagatagaatagtccatggaacatgcttagcacagtgcctggcacatcatgaacaataaatgttaactattatcaatactgtcattatggcatgttcatgattccaggtgccagtcaacaaggttcaagaaacatgcttttactttctactctttttacagctgtatctaatcatgatgagctgtagtattacagagttgtaagcaacttaaccagatctgctaaagtttgttaagtgtgttgactctacaaagaactgtaaatgtgaagtgtcatttccaatttgaataaatacaaagagggatgaaaatcatttgagaatgaaggtattgacttgggaagagtttaaaagccttacacaagctgtgatattgtacatatgttttctcagtgcttatgatttctgattttgtatttgtaatatgagaatggttaatcttccgtgtttataaatggagccccattgtagttgatccttcccagattgtaagaagatctgatgctcaaaaagacaaaaaaaaagtctttgggccaattattgccaactttttctgacgagtgctatgtgatctaaacttgctataaacacagacatctagggtgaagaggaaatgtgctaagaaaatggctcctggtaagagaaaagagagttactaaagtagatgtgatacgaggtcctaccaggttaatgtgttgtgtctgaagaactctatcctcacttaaggctctaggaaacagaaaaattaattaattctctccctaaccaggtctaattctctcttgaaattttagagggagaaataagcacccatttatttaaaaataaaaaacacatggaatcttagtaggttatagactccttccctatttcactctttcattcatattctcattctcactttgtcgttttagtttatgcacatattaggacctctcactcaggccacatttatctagtgtgtcagccactgactaaacagtgaaagaacataaaacagcaactgcaatcagtgtctgcaaatgtcatgcagtcccaccctgactcatgacttctctttccgtctctgcctgccctggacccaagccccagctctgtcttcttgtgctggctgttggctctctctgcatttttacctcttacctccacaacctctctgttacctcctctgttgcctccacatcttttccctgtcctgactcacaaatctgtacactccttctattcctcctgtcctgctcagtgaatttgacctcattcctcagaagctgacctctttggcttagccacagagaaggcttgcttgtcagttagtccttggcagctaaagcttgatttacaggaccacactcctgtctgattccagcctcagaggcagccacggaaggcatcttggccctcataaaacatgatcctttaaaggcgttcacagaaatagtatatgaaaatcctgtgattacctttgagtcttctattatccctgtatcattcacttatgaaacagtgaattttgggggggacaaaaggaaaagaacttgatcaagacaccaacacatatatctgcattagccacaatcctgaaagttagctcaattaaaccttcttaattaactcagagaagaataacaattgttattctgactcagagcaatgtttttcatacttctgtggaggtatttgtgatttcccagaccctgccacagacctacacagcctgaatctctcaggagggtcctgggaataagcatttcagctgtttacacaggaggcaaaaaaacacaaatgtaaggaactaaacaaattttctcatactacactcttaaaatattgtttgttctcaggagcaggtgttcttaccaagtaaagagcgagacccagatggaaaagatccttacttcacaattcgtactttttatcaattataccaaacccttacagaccaaatcatattcccaagatgttaaatgcacaatggttactttagaggcataaaaagtttcattttagtatctatacattgtaaagtattttagaaaaaaacaactaacccattaaacccatgatttcatggatattattaagaaaagttaggttttaaaaataagacagtgtagaaattgatttaagaaaaatattaagtaaataatcagacaagaggtataaggatatgacacaattatgaaaatggtactaaaatatctaaagttcaggaagcacagtgttaactaagtattgttttttcttataaattgaaagaagaagagttggtttaaaaggttaggtatataagctcagatttaaaaaaagaaaagatggtatactagaaaaagcactgaacctagagtcagaaaagctatttgaatactggttgcaccacctatgacctgtgtgaattaaggctagcaactcagcattgcggagcattaactccttaacctgagtgattcctaaaagatgtatttgattctaagtttccttccctttcctttctcctcctctcctcttctctcctctcctctcctttccttccttttctccttctcttcctgccttttccttttggagttgtttccaaccaagaggcaaaatcccttttcacatccccagcctctgttctgttatctatatttttgccataaaggttagtgcagttccctgaagtcaattctctacatactggtaaaaatccttggggatctttgggaatgagtttttcataagaatgtaaattaatttattaactagaatgctgtggattgccttagaggggctcagcatgggaatggctgcagagttgcaaaaagattctgattccgctctgcctacaaaatcttccccaagaggtcacaggagccagctgacgccactctcctccttagatcctaaaggaattattttccaggatttgcaggcagtcttctaggccagctgaagaagagaagatttatgcaagcagcctgcttggctccagggcccttgttgcattgaggaaaggaaacctgggcagtggtagacaggatcaggagcctaggctccaacccaggaaagcactcctgattttttaggctctcccaaattaacagcatcttttctgacccatctttgtgatgagacagacctgagttcttctaggcaacttggcacacacaataaagtccatctgcctttccatgcacagccctcttgccctttattcgtggtgaggcggacatttggacacaagtgttggccagcctggctagacatgtcctttttttctcagtcagatcagaaggtggtggtgcagcaggagcctcagccttacaggcagaccttctcagctgccgcctcacacaatgtcccagctcggctgcatctctgctccatgagtgggggctgtgtgaactcgggagggcaactgtgaatggcacagcatctgatatgaatttatcaccggctgctggtcgggagggggatcaagctaggggaaggggctgtgtttaatgcaccctgccacaacccaacagtttgccctaaagagccttttaccaatataaaaggacagggtcaaaagtaagttgacccctgacagaatgtacaattattagaagaaggctgtgtgcgagcagctgctggaaccccactgactctgcatcgggcttccaagagtcagattatgaataatcaactcaagattgttttctccacccttctcaacctccccccgcctccctccaatcttctcctcctgttttgggcaagtcctattctatttctacaggaagaagcatagccctccctagcagctgcaataattgtgttcctattgtgatgaagacctcctcctggccacccccctacaagtggccattgtgagtggaaagtcagtgattatacgctccctctgatgctttgggggacccagctgcctaagtgctgacacaggagtgtgcagaaggccagggagggggctggtggaggtggaggcaagaggtgggggaaacccacgtctgtgagactggactctgacataccagaccttttgcataagtcaagccaagaacaaatgaggcattatcaggccccagtgttgagaggtctcatctccctttgaagtggagctgagcgtggggccaagcagcttttcctcctttggaccaagcaaacatccttcttttgatatgctacatgctcattatctctgccccatttaatgatttttgattgaagggtggcggctgggatgccgagaggatcgttagagaggctccatacagccaagcccataagaaaggctttccttgtgcctgggcctaaatttggaatttcttaacagtgtgcgcttgttcttagaggcagataaaggctgagcgtgaaattcttaattaagcaataaatagagagtggggtgtcagcagatgtagccagtagccatggcaacaggaatcacatgggcaagagagctgagactcgatgtaggcctcaggcctgggcctgactgacagctgaagaatcctacaaagcttgtaaaccagattaattagctgactaattatttcatagcgttaatgtaactaaaaaataaaaatagttcaccatgaactgaaacatccttggaaaaaaacagcagggaaagaggcagtgggaaactggctctgtaaggcaaagacatgagcagtcagggcatcaaatcgcatgaagggaaaaatgggcttgctggatttttctcccaactttgcaaatataaaagaacacttgttctacagtcatacccattcccaagcacggcatagaagctacagttgggatacacgataatagttcatcgtattcataattgtttatcacatcaaatattgctcctgcagcatcctaacacaaacaatagtgcacacaaggttcttcacttgtggtctgtttcataagtagctccttgggcaaaattctcagcagctttagaaaggcaacatgaaccaatctccctaacagatctttttaaatgagtgaggttatcttattctgtggctaacaattgcttaagtggcatcacatttcaatcacgggaacaatatatcatatatgtcatattatggtgaatcccatttatctcacaaaaatctagtaaaagaaaatagagggagaccctttcagaaaggttataacatatacactgagctcatgacacatggtattgttaatcttctaaaaagaaagaaaacttctagagaaatagtctatcaggaaaacgttggtgaaataacatggcacattaaccacacttgaatatatttggatgttttgtgccacaattccaagagacaagtaagtattttcttaaccttgctgtgtaaacaaagccactgaggcatggagcaattataatgcaatgccccaggtaaaataaccagccagccactgattaaaaccctaagccccaagcactggccatgagctttccaaaaaaactgcactccgtgaagatgtttgctgagcaaaggcaaaacttgccttggtagaaaagaaaaatgcaagggtcaaaacatattgtatgcgtatgatttttttctttgtcactgggaatccttgagaagggttctcccacaaccctgcctagcacccccgccatcctttctggtcagtgatccacaattatttagtgggcagcacactctagtggagagagccacagccaggagctagaatgcctgggttcaggttttttccactcagctgggttgaagatgagtcaggtatcttaaatcacacatgcagcagccaaacagaggaaatgaagataattgtgatttttctaaaacttcctatcctgggggaagtggtaaaacaatacaaaagatggcccacttagaagtggtcaaccagtgaatgaaaattcagccagttgtcagtgaagcagcactctgaaggaaatgccagccaagaaaaggagccacacccccaaaaaaatctaatatggaattccgtggccatgatagagatcaagcagcttccctacaataaaataaatttctgtatacacacatttcccatgtttttcatcccaggaatatgtccacatagactatgtggtcttgacttacaccatctgcatagattaaatgtattttatgtaaattatcccagtcatggtcctataaagtcaagtggtctgaaaaaaacagttaagtgaaagttacaatctaatcaatatataaaatgcatggcacagaactggaactctacttcttgggctcttgctcgggtaccaacaacagcaactaccattatggcattgggaaatgcagtcaggtatatggaaaacgtggaagcctaatcaccaccttgctaaagatcttataaactttacacagatgatatccaaaattacagctaaatttacacaacccagtatagctacatggcgcactgccatggaggagcagggtgagcctcagttcctgctgagtcctcataccatcactgtgacagcccagaaatgagaacagaagtggctctagccagctatccactccatacactcagaggataaaggaggcaccaatgaccataaaagatcctacggggaatcccttcaagaagcaagagtctccaagtttgttaaacattcaacaaatcctctgtgacttcttattccttttccaactcatattcaaaggaggagatactagggtattccaatacaaataatttttaaaaattaataaaggctatctacctaatagaagtgttttatactaagacattcatttatatcatacatatgcacagatacagatgtacctctacatataagcacacatgcacattcacacagctacttacacagatgtgcatttataccatatgtgtatatataatagtataacttgctattaattcaattaataatgctatcataagggaagaaaatctatagctgcatgatttaattttttttctttgtaccataaatggtttttattacgtttagtttatttgagtattcagattattttgcagttcatgaacagaatatgacctatggacaagacagcctcttcagaagcaggctaagtaatggaaagagagcaattcagattaaaattttgttccagaatacatatcaagtgaatagccataaagttaatggtaactatttactcttatttatggctgtattcggctgaagtggtaaaacaatctcaggaatctctgtccgtctcaagtttttatagttttaggttacatttatgaatggatcaaatcagaaataaaatttgaatggtataattcagtgcaaataaaatatacgacaatccttttggcaaagacataaaaaaagaccaagggagcaccagactctctctctgatgctattaaaatttaacagttctggggctagcctgtaggtccgactcactggacttatggttaggcacaagtgaaagaggcaaagggtggactcaggaccattgcctcgccctctaaatccatggccaccttgggcttgtggcaggggctagaacttgttatgctaataagatcccctggatttgaccaggatctactaagagcaatttataacaaaattgtcactcttgagacctatttagccagattctcctttttactgtaagaagtggcctcacagtgagctgcgattggaacaagcaggtaccatggtgctcagagagaccaatgctgacatggtatagaaaaggaatatgaaataaactccaggaaatcaaaagaagtggatggtcctgacacactggtatcctgagaaacatgcacagtaagaagataaggaaaaacctttggcctctgtgactctgcagtcacagtagggttcctgattacttcaacctcatgttaatcttgacgtaaaacagacacagcccacccctagtgctcatatcagccctccatgctactcatcttcctgacctcagattctcatcagaagttttccttctcaccttctacataaacttccgtcttaattcagcctctctctgcattggtactctctaccttggactctctactgttcctcataccaatggtcataatcagccatccatttttttctctttcttttttttatttttgagatggggtctcaatctcttgcccaggttgaagtgcagtggcatgctcatggctcactgcaggctcaacttcctgggctcaagctatcctcccacctcagcctcccaagtaactgagactacaggcatgcgccaccacacccagctaatttatttaattttttgtagagattaggtctcactctgttgtctaggctgatatcaaactcctggcctcaactgatcctcccaccttagccttccaagtagctgggaccacaggcacatgccaccatgcccagcattttttttttttttttttttttggagagatggggtctcactttgctgccctggctggtctcaaactcctagactaaagcacagccatccatctttacatgtgcagttgttccactacaaacaaatatgacactgccctaagatgaattaaagatattattagtactaactaccaatgtctagtaagcattttttgtgggctaggccttctgctcaagagttttacatgttattctttatttaatttcctatcctttgaggtaggccctatggtcatacttctctatagaggaggaggctgagccttagagaggctctgtgtatgctagctggtgagtgttggagctgggatttaaacccaggcaatcagacttcagggaacattcactcaaccataacacacagctgtccctttcagttcctcagcacttcacagcacaaatgtctggaattgaagggtgattggtgatttctgactatgtgctctcaaaacattcatccaattggatacttacccagataggtgagttgcctcagctggctattgaagaaccagtcacagccttggttctgacctggtgatggaagaaatggaaaagacagacccactcgactcccacatcttaggaggatgtcagggtaaggcggcaaatctgtgtgcaccagcagtaggtaattaccaggagcaaagttgtcaaaggttgctgagtacttgaagtgaaagaaaaacacaatagtgctcatttagtaaggaaccccatcattccacctactccaccacaccaccctgccaaaacaactacagagaacgcagatggagtagtttagaaatcatacaatttagacccagattgtacttttcttgtgggaaatgggaatacttaaatctacttcataaaaaattcataactagagctacaaaatcagactatgaagactgaaagatgccataaggttcatctcgtttaacaatctcaattaccagaggagaaagccaaggcccagacatatgaattgacacgtctcaggtcaaacagctagaagagacaaggccaggtctagaattcctttccagcttttcccacgacttgaagcgacaggcaatgataggcatgtcatccatttatcacagtaatagctaacattgtgggagcatttactatgcaatcagcactattcagtcctcgaaaggcacccctgtcattgttactcttactgtcccatttttacattgaggaaactgaggcaggcagaggttcagtagcttgccccatatcacaaagcagaagagtgcagtgtcaggacataaacctagggtatccacctccagaggcacaccctactgttttcactgcatgaaaattctccagagtgctctcacgggaatctcaaggcaagaaaagagaggcgtacatcctttctgaaagccatggagagaagatcaaaagtgattctgttctgaattcctcatgaccatggcagggcttctgtctccctaagataggctctcaggactgttagcaagaatgtgtatgataagataggaagaaatatatgtgttaaaagtatgaaaataagcttagggaattccactggattgctgtttaaaaatatggaaaaatgtacccactttcctcatggccatttttttttttttagtttttttttttatttcttctgaaaaaaaaaaaaacaggatacaggtgcagaacgtgcaggtttgttacacaggtatacgtgtgccatggtggtttgctgcacctattgacccatcctctaagttccctcccctcacctcctacccccaaacaggccctggtgagtgttgttcccctctccatgtccatgtgttctcaatgttcaactcccacttatgagtgagaacatgcagtgtttggttttctattcctgtgttagtttgctaacgatgatggcttctagcttcatccatgtccctgaaaaggacatgatctcattcctttttatggctgcatagtattccatgatgtgtatgtaccacattttctttatccagtctatcattgatgggcattttccatgtctttgctattgtaaatagtgtggcaataaacatacatgtgcatgtgtctttacagtagaataatttataatcctttgggtacataccctgcaatgggattgctgggtcaaatggtatttctggttctaggtccttgaggaattgccatactgtcttccacaatggttgaactaatttacattcccaccaacagtgtaaaagcgttcctgtttctccacagcctcaccagctttcattgtttcctgactttttaataattgccattctgactggcatgagatggtatctcatagcggttttgatgtgcatttctctgatgatcaatgatgttgagctttttttcatgtttgttggccgcgtaaatgtcttcttttgagaaatgtctgttcatatcctttgcccactttttgatggggttgtttgtctttttcttgtaaatatgtttaagttccttgtaaattctggatattagacttctgtcagatgggtagattgcagaaatattctcccattctgtaggttgcttgttcactctgatgatagtttcttttgctgtgcagaagctctttagtttaattagatcccatttgtcaatttttgcttttgttgcaattgcttttggcattttcgtcatgaagtctttgcctatgcctatgtcctggatggtattgcctaggttttcttctagggtttttatggttttgagtttttcatgtaagtctttaatccatcttgagttaatttttgtataacgtgtaaggaagaggttcagtttcagttttctgcatatggctacccagttttcccagcaccatttactgaataagagatcctttccccattgcttgtttttatgaggtttgtcaacgatctgatggttgtaaatgtgtggtgttatttctgaagtctctgttctgctccatcggtctatatgtctgttttggtaccagtaccatgctgttttggttactgtagacttgcagtatactttgaagtcaggtagtgtgatgcctccagctttgttcttttgcttaggattgtcttggctatacagggtcttcttcgattccatgtgaaatttaaaatgtttttttctaattctgtgaagaatgtcagtggtagtttgatgggaatagcattgaatctataaattactttgggcagtatagccattttcacgacattgattcttcctatccatgagcgtggaatgtctttccatttgtttgtgtcctctcttatttccttgagcagtggtttgtagttctccttgaagaggtccttcgcactgcttgttagctgtatacgtaggtattttattctctttgtagcaattgtgaataggagttcattcatgatttggctctctgcttgcctattgttggtgtaaaggaatgcttgtgatttttgaacattcattttgtatcctgagactttgaagctgaagttgcttatcagttcaagaaattttttgactgagatgatggggttttctaagtataaaatcatgtcatctgcaaagagagacaacttgacttcctctcttcctatttcaatgccctttatttctttctcttgcctgattacccggccagaacttccaatactatgttgaataagactggtgagacagggcatccttgtcttgtgctggttttcaaagggaatgcttctagctttggcccattcaatatgacatttgttgtgggttggtcataaatagctgttattattttgagatatgttccatcaatacctagcttactgagagcttttaacatgaagggatgttgaattttatcaaaggccctttctgcatctattgaaaaaaatcaagtggtttttgtctttggttctgtttatgtgacggattatgtttattgatttgtgtatgttgaaccagccttgcatcccagggatgaagccgacttgataatggtggataagttttttgatgtgttgctggatttggtttgccagtattttattgaggattttcacattgatgttcatcagggatattggcctgaaattttcttttttcattgtgtctcttcccagttttggtatcagaatgatgctggcttcataaaatgagttaaggaggagtccctccttttcaattgtttggaatagtttcagaaggaatggtaccagttcctctttgtacctctggtagaattcagctgtgaatccatctagtcctgggctttttttggttgtaggctattaattaggctattaattactgcctcaatttcaaggcttgttattggtctatttagggattcagcttcttcctggattagtcttggtagggtgtatgcatccaggaatttatccatttctcctagattttctagtttatttgcatagacatgtttatagtattctctgatggtagtttgtatttctgtggggtcagtggtgatatcccttttatcattttttattgtttctatttgactcttttctcttctttgttaatctagctagcggtctatctattttgttaattttttcaaaaaaccagctcctggattcgttgatttttttggagggttttttgtgtctataactccttcaattcttctccgatcttagttatttcttgtcttctgctggcttttggatttgtttgctcttgactctctagctcttttaattgtgatgttagggtatcgatttgagatctttctagctttctgatgtgggcatttagtgctataaatttccctcttaacactactttagctgtgtcccagagattctgatacattttctctttgttctgattggtttcaaagaacttctttctgtcttaatttcattatttacccaggagtcattcaggagcagattgttcaatttccatgaaattttgtggttttgagtgagtttcttaatcctgagttataatttgattgtactgtggtctgagagactgtttgttattatttcagttattttgcatttgctgaggagtgttttacttccaattatgtggtcgattttagattaagtgccatgtggctctgagaagaatgtatattctgttgatttgggatagagagttctgcagacgtctactaggtccactcgatccagagctgagttcaagtcctgcatatccttgttaattttctgtctcattgatctgtctaatactgacagtggggtattaaagtctcccactattattgtgtgggagtctaagtctctttgtaggtctctaagaacttgttttatcaatctgggtgctcctgtattgggggcatgtatatttagatagttagcgtttcttttcttgttgcattgttccctttaccattatgtaatacccttctttgtcttttttgatcattgttggtttaaagtttgttttatcagagactaggattgcaaaccctgtttttttttttttctttccatttgcttggtaagttttcctccatccctttattttgagcctgtgtgtgtctttgcacataagatgggtctcctgaatacagcacactgatgggtgcctgactccttatccaatttgccaatctgtgtcttttaattggggcatttagcccatttacatttaaggttagtattgttatgtgtgaatttgatcctgtcatcttgatataatttagttattttgcacactagtcaatgcagtttctttgtagtgtcattggtctttatattttggtgtgtttttatagtggctggtaccggtttttcctttccatatttagtgcttctttcagctcttgcagggcaggtctggtggtaacgaaatccctcaggatttgcttatctggaaaagattttatttttcttttgcttatgaaacttagtttggctggatatgaaattctgggttgaaaattcttttctttaagaatgttgaatattggcttccaatctccactggcttatagagtttctcctgagaagtctgctgttagtctgatgggcttccctttgtaggtgacctggcctttatctctggctgcctttaacagtttttccttcattttgaccttggacaatctgataattatatgttggtcttctcatggagttggggttggtcttctcatagagtgtcttaatggtgttctctgcatttcctgaatttgcatgttggcctgtcttgctaggttggggaacttctcctgaataatatcctgaagtgtgttttccagcttttttccattctccctgtctccttctggtactccaatcaatcataggttcagtctttttatgaaatcccatatttcttggagaccttgttcattcctttacattcttttttcttgtgtgcatgtcttatttcagtgaggtggtcttcaaactctgatatcctttcttttacttggtcaattcggctgttgatacttgtgtgtgcttcacaaaattctcatgctgtgttttttggctccatcaggtcgtttatattcctctctaaactggatattctagttagcaattcctctaactttttatcaaggttcttagcctctttgcattaggttagagcatgctcctttcactcattgtagttttttattacccatcttctgaagcctacgtctctcaattcatccatttgatcctccatccagttctgtgcccttgatggagaaatgttgtgatcatttggaggagaagaggcactctggcctttttggttttcagcattttctcgttgattctttttcatccttttgagcttgtctagttttggtctttgaggctgttgacccttggataggatttttgtgggggcctttttgttgtttttgttgttgttgatgctgttgttgtcgctttctgcttgtttgtttttctttcgggtccctcttctgttgggctgctgcagtttgctgggggttcacttcaggccctattcatctgatttgctcccatgcctggagatgtcactcaaggagacaggagtgcagcaaagatgggtgtctgttccttctgggacctctgacctcgaggggcaccaacctgatgccagtaggatcgctcctgtatagggtgtctgacaacctctgttggaggatctcacccagtttggtggcatgaggagcaggacccgttcaacaaagcactttgtcccttggtggagagggtgtgtttcactggggggaaacccactcgtctgggctgccgggattcctcagaactatcaggaggacaggccaagtctgctggtccacggagactgcagctacccactccccctggggctcagacccagggagatatgaattctgtcccggagcctctggctggagttattggagatcctgcggggaagccctgcctgcccactgaggaaggatgggtcagagttaggcccaaagaggcactctggctgcagacagccacagctggtatgttgggctgtggggacaagtcttgggacaaagccatccagcctccctggctccaacagggaaaaaacgcagcctagagctatagaaatgggtgctgcctttcccccatccacagagcttagcatgttaggcagttgcaagtcccagtgctggctgctgcctctcctgagctccaaactgggagctcaaatggcttagacagcaggcagctgcagccagtgctggtcgcccctccccgcgggagtttggtaggcttaagcagattccagctgagaggctgtaagaatctgcttagggctctaggcccgggtggtggtgtgggttcgcgagtgggatcttccgacccatgggttgcacaattccgtggaaaaagcagtttccccggctgggtagcggctcactcaccgcctcccttggctgtggggaacggagttccttttccccgtgtggctctcaggtgggccaccgcaccacactgctcttccttctctccgtgggtcacgccagccttctagtcaattttgataagagaacctggataccttggttgccgatgaaggcttcacatgcttattatgtttttgttttgttttttcgatggtagcctccgaacgtctctgtttctagtaagccatcttgccacacggccatttctatcttcactgctcttatttgtctcccttaacccaatccagcctggggactcatacagacttcgattggcaagttaatctttgaccacaaggtggcagtatgcaatgtataaatgctttggtaaggcattttctctggctacaaacacttctctctagggtaaattggctattgaccaataagttttaaagaaatgcaatgctataagatgtgtagaggttgtttctcattgtattaataaatttaaattttcaggcgtaaccattctgcattcacaataacacataaatagattctaaaattttcaagtttaaaaagcaaccaaatctcatatttagcttatattcatctggccaaaatactattgaagttttctttatctgcatcagaatatgccaagactttcaataacgagataacctgctcctctttcaacccattatctcaaacaaagaaagataagaacaaatgagaatgcagcataccaactaatggattccttgggttacctgcagagatctgttgatccaaaggttctcagattgcaatgagtaggtctcttggtccaagagcagagccatccagccacgagggttagacaatgtatcacgtacataattgacagtggttgttttatttctgctgtcagtcatggttaaatcataagaaacttcaggagtattcgctctaaggtgattttaaaaggaaaaaaaatgggttgagagattatttgctcattctgaatccaatacattcctctttcatcaattgcaatcatctttccattctctccacatatgtcttaggccctctttagttgtatgtctagggaggttttagcagtcactgtgtgagtgaaaacaacccagtgggaagttgccattggatcatttgcaaattacaatgtcctggtgaactggaggtggtgactctcaggttttttattttgtttgttttttgtttttctccttgagacggagtttcgctcttgttgcccatgctggagtgcaatgcgcagtctcagctcactgcaacctccaccactaataaatgtcacattaatgattttgtatgaaccaagactatatactatgattttaacaaagaaatgtctatggccagaattttgccttggaccagatttatcaacagcaaaaaacattattattggtaattggatattcacatgaggaacaattgacagaggcctgggacctgacatgcctaggtgctgagactctcagaagtcctgctcaaaatgcccagcaggagtggcttcagcatccttctctagaatgatgaggtaacctgctcctctcctgcagtcttgtgtaatgcctagtactcactgctattacagtacctatgtgttcttggctttgcctttttaaaaacatagattataagatccctaagttagaggtgttttcccctttcttattggtatcctctgccctggcacagggcccagcacacagtggcacccaaatcatgtttgttatatgaatgaacaatgcatagatgagatcttccaaaagcagccagtgacattttctaatgtatataaagttctatatatagaacgtataaaaacgttcagaagaactgcattttaccaaatgaggagactgaggcagggtagagcaaaagcaatatgtgagtatcacaaagtagaactcgaaatttgtgaatccagttacccaacttattctatacagccatcccagaaaatgatttttaagacttcattaaagcataagtagatttagccaatgattagacccctaaaagagagtgaaagtggacctaaagaaataaagcaaaatccaaaaaaaaaaaaaatcaatacacattatgactgttcttcctcctttggtttagttttcatgagaatctttaactgtggcattttgccgcaggcagataattaaattctcaaagtaagggaaatgagtcaaaagaggacattgggttttcacagtgagatggggcatgagtatatctaaagccaatttataagcccgtggaataattcaaaaaggaacttttttaagtgttgcacacttgggcactggaacaaatgggtaacaactgaaatctagattggcactcagtaggtgtgtaaacctgggcaaatttcagcacctatttaacctttagattcatttctttttaaaatggaggcaacaatagaatagatctcatataggtactatgaaacataaagataatctacataaagcactcaccaaggccaataacatctacttaggtctcatttaagaacctcaaatatgccagatttaccattctgcactacttatttgaatgcctagaggtttattcaggatattcggtcatttaaaaacataccaaaaacccttccatggtacagatcattgaccctggcaatgtagcacttgacacatatttcttgcaagattaaatgtatttgtttcatccatgaactaatgaaatgaaagggatgaaaaatgctcagggcatttgggaatgaaagaactattcttttttcagatttccctatgcagcattaactgaacctttagaaatcttgtgaggaggggaaaatgtcttcctttctttgggttttagatacttaggtttgttgtccacccttccccacccaccccttcaggatttaaattggaactaatggacaattctcaacctatattcttagaatcagaatgaacacaaagatcatctgttctaatttccaattcagtgcaggaattcccaccatatttcatccctccccttctttcagttatggggtgtttacatcttcgaatagaaaacattccatatatgggatttagttttaaattgtaatctttagaaaagctttagaatgttaaatttcccttcttagaatttctagccatttgcgctcagtcatcatggctctctcttcccctgatggaaaccatgagtcccataatcccaggatattttccaggaacaatttggcccaactatatttagcaaataaaaataagctttggggacataagtgtaaaacaaacatgataagaggtaagttcgaactaagaaatgtcaaaattggctacagtaggtactgtggtcagtaaataaaacacactagaaatatctaaatttcctcaagtacagggaatgattataagtgtttcaggttccaaaagtatatccttccagtttttactgagacatatgggcttggatttatttaaataaatcttgtgatttatttaaatcacaagacctaaatccaagagagactaattgataaatcagaatttttagttaatgattgaccataagaaataaaagtgcctttcatatagtgggagtttaacaaatattttctgactgaataaacaagtgttatatgcatcagaacactccagctggttatgcagtaacatttctccccaacttggaagtctacctagaaaaatcacatgagggtcaagagatttcctgcaaacttattttcaaaagaaatcagcagttgggtgatcctaagttattagagcttgatacaatcaaccccatatcagtaggatatttgccaagaggacaaacatagtcagtggtcagaaaacctctcctaggcacacacaagcaatgtgcactaataatggtctctggtctaggaaaatgctatgatttccttgaaaactcatatttctgcaatcctagtcaagtgctgtcaattaaaccactttttaaaaatagttttaactacaaaccaaaagaagatctctgttcaaaagcatccatctgttcacatttaattcctcctgcctcacctatcttctcatgcataccacgttgatcattaaaaaaaattacctcggccgggagcggtggcttatgcctgtaatcccagcactttgggacgccgaggcgggtggatcatgagatcaggagatcgagaccatcctggctaacacggtgaaaccccgtctgtactaaaaatacaaaaaattagctgggcgtggcagcatgcgcctgtagtcccagctactcgggaggctgaggcaggagaatggcgtgaacctgggaggcagagcctgtagtgagcagaaatcgcgccactgcactccagcctgggcaacagagcgagattccgtcccaaaaaaaaaaaaaaaaaattacctcaatatgtgatagtataatcaattgggtagatatttccagaaatattttttaattccagcaatgtggtcccaagaattcccctggtcaccttaactggacttaattgctcgtcaaatttcaattaacaccacatttacagaccaatttttaggatgttatttcccctgactcagtttctgtagattacaatttcaattattgaaggaagcatttttcagataatctccccagtttctgaaggcccatacaaatgtggtccctcttcaaatagtgtcaaactgctaaatgctagcaataatttggttctatttgtctttggaaacattgcaccttccttttgaggttcttctccttctagtcagaatccaataatctgatgcaaactccttggccaaccagagacataccatagcacactgtgatcctaaattactttcttatttctccttcatgcactgctcattctctcagagccttgagtctatcaagctcccctcacccatctcaaccaaggtttattagggatgcaatttcataggcactcatgtgcagcaccagctttctgtagtgcaatacaggtagagaaggaggttatcatatatactacacttttatcacagctgataggagagagggtcatatggtaagcattcagatatgctttccactctgaaaagcaactcaaaaagcaaaagacccatctcccatcaggcaagatggcttgtactgaccatcaccaggggccaaaaattcagtcaggtcatctcctgtcctcctaggccaaatgccagaattgaccatggaggggtcttctgaaaagcaccaaaagaacatcaagagtccaaaaaacaccatgaagagaacttaccaacaataattactacaattttcacttgccctaaatagccaccaatttccccatgccctaaatagccaccaatctcccactctttactgttaatgaagcaaaggagcacaaaagtatttctaatttggaggagccaagggagtctgcatgggccattagcagtagagagcttcattactaggggaagaagtctctccctgaacttctcatggctttatgtgcaagaaatcaggaggcaaccagtccattttaaatgttaacccttacctctgcatcagcaacagctcctcctgtctatgatcaaaaagacaaaagggctataagccttacatgttgtttttcttttctgtgggctgtcttaatgtttgttcttttttattttattttttattttattattattattatttgagatggagtttcactcttgttgcccaggctggagcacagtggcatgatctcggctcactgcaacctctgcctctcaggttcaagcaattctcctgcctcagactcctgagtagctgggattacaggcacccaccaccacacccagctaattttttatatttttagtacagatggggtttcaccatgttggccaggctggtctcgaactcctgacctcaggtgatccacccgcctcagcctcccaaagtgctgagattacaggcgtgagccaccatgcctggcccaaacctgtttttaattcagggaaatgttccattagaaatataacactatcacttggtaaaacttcctggtcaaagtaccaatttaccatactagttacttaaagagttatgtaacttagtgcccatgtactgtaaagaactgttgaatcccacaaaggatttgttaggcaatcaataataccaatgagagcagatattaactccctggtttttgtttaccattagcttacttttcctgagggtccatatctgtgtattaaagacaagcattgcacagagctctaaatgctcttgatttggaacagttgtgaaataaatcctctgtaattatccatctcctaagccagacacaccacaatacctaacctcaaattgtgttgcaaacatcttctgagtatttgtgcttgttgatgtcactctcatcttttactgcacaaaggggaagaaaaatcaaaactgtgggcacagccaacaaatttctgtggcatggttttgcatgagcatcctttaaaaatacaccatgctcataacaatccttgtcacagcaccactattctatctgctaacacctgccaccattccgtaatatttcattatcattgtatcattaagtttttccatccacagccttatggattcagaaacacttaaatatttctcctctaaggaagtatctacagtttttgcaacatagttatctgctgttatattaggacaatactttttgcccattctatcttaatatatgaagaaaagcaatagatgtccattatcctactttaggtgaccatataccattgcatctctacttttgatctgctgagtccaattggaatggctatttgagaacacgagaacactgttattgaagctatgcaaccagaaggtagacaggtggacaactgcttgtcagggatattgaaaaatattttatccagcaggtaggaagttagactaagaagcttgtcctcccatatatatgcataccagagctgtgatggggatgactgacactggctggcagaagcccatcattgacccttcttcccaactatatgttcagtgcttttaggttggaagcttaaaataaggcatgtgagagtattttcactatagaattaggcaaatgaaataaaccagagctttttattctggagagctagttgttaaacatttaccagcataccactgcaaccttttattattcataaaacttaataaccatgtaatattgttgatgatattcctcagtttggggtccattgtgatttttagatctttttctactttaattctgtaacctttgctgccaagaaaagataatacatctttgaattttcttgtctcacagggttgttttttaaggactgaaaagataccattagtgatgccatgcctatttatccctaggaaggaaagtcaagcgattattagaggaaaaggtaggccaaaatttccatttgaactcttctttatttttgcattcacagaggcagggggtgactcgtactttgaacactgacaccttaagagtggttacataggtaaaaactgaacgcaagcactacaggagaggatattaagcaagatctaagaatcaaggtgatcaacaagaacactaaccttttattttccaggagaggtgggaaggaagaaacagaaggtactggggcacgatgaatcaaagtcaacgccctgaatgacctgaggttctacaaccacctgggaggttttgctgggtcagtacaacgtcatatgattattacaaattattccctatttttcaggaattggattaagttacattacctaattcccttgccaggcatttgtttctcagaaacaaaaaattctgcagtaacctattcaattagtattatgcctatgcgttgttttgtaaatcacaaatgtaaaatagatattctttaaagagtacctactacatgtcaagcaatgaccctgagggataaataccattatacccattttagtgatgaaagaactgaaacaaaaagcggtaaagtaacttgtgcaaagaaatatacctaggaagtagaggggatatgacttgtacccacaaaggattgttaattacttctctattcttcagtctgaaaaataatttcaaacatgtactgtatatatgtcttgactattttatgtacgtcctgtaaaaactcagaaggactggtcagccaacctacaaaatcttgcaagctcttctaatctccctcacactcaatacagtcaaaaattcgaagacagaatcaaggtctgatctgttgatatctcaatgagtctacgacaagtgaagaagttatacattgctgtaaacaacaatgacaaaaattttcgagaaaataattataagggttgagcttacatcctctctatcacagttttatgtacctattccaccaggacaagaaaacaattacaaataaaggcaaactgatgattgaatgggggtagagaggggttggatagagaaggaatcagcaattagaataaatcctccagtcaaatgattgccccaggaaagtaaaagcccagagaagattatgaaagaagattcttaaatactagatattcctaggaattttagaagactggagatagcattttactcctgggtcttctgaagaaaagccgaatgctgtggactcctcatgaacatgtcctaggagagaaatagacaataaggacactaaaggaagatctgggggcagtccactattttttatttatatttttttactcaacaccaattttgttgagttgctatgtgttaaacagagtttggggcatcataatacaaagaaaatccctatttgccctccttgccatttataaggacagacggacaatttagaaagctatgcaggtgctataagtactgattagagcaagtataaagagctagcacacaacagagatatcaaaacctgcgcagcatgctcagggaagcctagcagagaaaacgacctctatgctgagttcatggaagctgaacattatgaattgaagagcacaaataagttgaatgtggctaagggacagaatgcaggaaaggtagagcagagtgctgagagataatgctggaacccaaagcagacagcaggacacggaagctccatgacacattaggaatgtcagactttccttggaaagcactgagaattctttaaaagtttcacgcaagggaatggatggcaagatcagatctgcatttagaaagttcagagattgaaacaccgaaaaatggcaagctaagtggctgttgtggttctacaggtgaaaagtaatggtagcccagactggagaaggatttggggaaggagagtagtagaaagactcaaaagggatttattaaggaggaaaattgagctgataggtgattagtgtgggaaataaggtacaaagatgagtcaaggatgactccatgtttcaggtttagaccagcatttgcctcagtgggattctgagcacccagagagaaacaggtctacagaaaaaaatcataaatcccattttggcaagttgagttttagagtagccacactaaaaagctcaaaataaacaagttaaattaattttagtaatatatttagcccaatctatccaaaatattatttcaacatgatcaatataaacaaattattgagatattttacattctttttttcatattaagtcttatctatatggtgggtaattcactcttacggcacatcacaatttggactagggagatctaaaaagagcacacaaaatcctactgataatattgtacttgtttcgtgtaattatttctatacagaaaaaaaaaatgtttacctaaagtttgggatagataaatccaagaactatgtgggacattttataattatgggaccctggagaaaaactgtcactggcatgtgtttctgatatgaggtcctgacttacattggcagaactaacactacccctgtctcaccaggaacactgaggttcatagggggaagctggtagaaacagaagctgggaaaggaacgctatccagaatacctgcggcttctacagaaagcatgttttcagagctgatgagagagaaaacaatataagcagcactcacgcagatcaagcatgctgtcattttaacaaaacataaactagactctgccttgtagagtggcagttttttcttcacccaaatattaaatagtgtggccaacttcaaatatttaaatacttctgtcatcccaactgctggctttgagtcataggaaccaataaagtaggaagtgccacaaaggtaagcaccgtcagatttaaggcagtgagggacaggaacagaaggttgccaatgtcaaacaaataacttatagtgaaaatggaccagagagggggcctaccaaggaagaactcacactccaagagcttggttcttagcagaacaggaagaggatgtcttgtttatgcagctatgtaaagcctcactccctgccctctctggacctcttactgagggagggagttaagggttgaaagtgaagacagcagggtgcttatgccatattagatctccatcaacatgcaaccccaaaagatcataactgtgagagctttgtaaatcaactcttagggtgcttgccccagggcaaatagcacaacaaattaatcctttctccatgaaatgcagcaaagtttgcatctatgctgaattcaaattgctcattagctctgacatgttcctaatgaggttataatgctttgggacaaagatcaagccactgagcacaaatagctagggatagaatcatagaaagataaaattagaaggaccttagaggagtgcctctcagactttaataccaatcacctgggcattgtaattcaggacatctggggcccagtctgagagtctgcatttctaaaaaaaatccctggtgctgctgctgctgctggtccatggacaacattttgagcagcaagaccttagagatcatctaattcagttgcctctcctagaggtgagcacatcagggccaagagatttataactggaagcacgctgagacttccaggtgactaattagggtcagttgagtatttgtccatagacctgtgagtcaacctgaaaattttaaatagaatctaaggagtagagtgaccaatcagcctagatgactgaggaagtttccagaacatggaatttgcctttttaaaacaagaaaaaaatccaggaaaaccaggataagtttttcatcctgctagacccttttgaatctacttagaacacagtatcagtattacatttttcttgaccttgtcagtccccaagtggtgggatcatgacctgccaaggcaagtaccttaatatcctgtcccaaagatctcaaagagcaaatgctcaaacaagtttcaggcactacagagccttctaacatcacattgacaagtgcctctccaagagacagcctaccagtagatctcaaagtaaagcatgataaaggactatcaggaacacgcagaaataaatattatagaagcatataatgttccttttaagtacacaaatctattttcctcatttgataaaatgcatgtaagaaataaatcactaatttttataactctcaaaacactcatttaaaacatccttggtaaaaacactaaaataataaaaatcaggctgcatccctgagaatgaagaaaaagtcatgctctgcacaatcaaaatgattagaaataaaaatatatccctacatattattattttactcactggaattgggctcattaacgtcaggtagaataatgaatgtctagaaagcaaaaatgaaaaatttccagactattcagtgctaccagtgcatcgctaaggcttctaaaacagaatgccaaagcactgattccacatgcattcaaaatacagagttagtgcaatcctaaccacaatgattctcactccctgaagtttacttgttcaagtaagaggccaatgaggtctgactgaattacttgacttaatactcatggagttaggacacttaagacaaaggaagaaaataagtgtggctaaatatatacaatgcatttggaataagtaaaagacagaaccctagacattcagcaatcattacctggaaattaaagagggcaggagcaatcctattatgcattataaacagccccgctgctgacttaatggtagtttgagtagcataaccaaggagtccttgctccaatattaataggaaatgtattgtaggaatccaatagttcatgaaattaacaaggaaaatgaactggagtgaagcaaccttgcaagtaataggaggcatcagcaattgcttccctggagcatattgaacacttaaaaagagcttgggaagagtacatgtatataaatgagaatggacatttttagaattttttaataatacttttaatttaaatatatttcaaactctctgttggctgtaagtctttctaagaagaagttattagcccaaaatgtcaatgagaggtcacaagctatgagatctggtccaaagatattgctagttagctgccatttgagtcagcttaaaactaccatacactcatgattcagcagctgtcaaaattattcccatttcacttctttagagctaaatacttcaaataatctagaaaacaatttcccttctataagcctcgacagccagaataacagatgcatgcccatcggcaagctaaaaagtatagttaattccacttacaaaccaatagacatacgatgaaaaagaacacctcctccacaggcactgccatggacaacccgaccaaagcttgaattgaccaaacaagaagctgaaagggtttccatagaagcaagaatgtgacttctgtttttcccagacagagacccatccaagtcttccaaaattgctgcatgaggaaatggaaatgccactaagtttgaagagtttgtaaacttcaactggctggtcttcacagtaaatccacctataaattggaaaacagaaagattattacacaatggcacaaatagcaactaaattcactggagtgatggtcttaggatttaaattgcatatttatctagttttacaattcacctattcatgcaagaaaaaaagtgttttctgtgggtgttttacagtgagtgtttactgtctaccaagctctggtgtgctagagatactaagaggtataactgcagcattggccctaccttcatgcagtctatagtccacattgtagggcagtgatttttctatcatggttgattttaccttccaagagacatggcactattttcaatcatttttggctgtcacaattggggagctggcagtgctactggcagctagtaggtagaaaccagagatgctgctaaatatcctacaatgcacaggacaatccccacaacaaagaattatctcacccaaaatgccaatagtgccaagggtaagaaactctggtctagtgggaaatagaagcagaaaacattaatttattaattactaagcaccaaagatgctatggtttagtcttccaatctttcagctttcattcctctgtggtgagtctaacccctccaatacctcttactataaggtttatttaaacatttactttcaaaagcaaactcaattaatcacttgggcaaatagtattagtaatacactttctaagtattagctgtagggccacacttcttggcagtctttccccaacaccactgccatgtgactcattggtactatcagtccaattgcctaaaaggaaagtatggcagtgatcttctaattcacacacccatgtcattaaaggaagaaaactaagtacacatctcccagtacacatactaccataccataatatattatgtacattataaaatataaaaaaaagaaaataaaatgaaaaagatacaaatagaggctctaatgttttcattctgcagcccaatagagtacatgcagtgaattgattcatacatgaaaggctacacaattgcacctcttgcaacttctgtatttcatttgataccacaaaccacctgcagctctacatttcagtcatactggacttctttgtgatttcccaagcacaacttacttcttggattctattttttgtgtgtatactgttcctagaaattcttccttgcatataccttcttgcaaacttctattcaccttcctaaaccctactcaagaataacctctatgagctcttgcctgacccccttcctcggccccttcactgactttgttgagtcctctattactgcgttcatcatgctctcttacaataataggcttggacatttattttagtgcctagatcaagagttcctggaggacagaaactatgtgttttttatatttgtaccccctaggtccttaagcagagcctgaaatagatggtatttaagcaaatgaaaagaggggttagccaatactattcagtgaaaagggattagagttcataggagtagtgtgattttttttcactgtctcatgaatgatatgaaatagtcaagatattaaagaattgaggaattgcgattgcaagcacttgttatgaggcatttttatttctattattatttctacaatcctaaactcagatgccacccaaataaaaacaatctttcattctgcctacataggaaaaaaaagtaaagtggagacttgttgattattcatttaattaaaaaaacaaacaattatctaaattggtgattcaaaccacaagagcatatttacttaaattacttggtttggctgtttacgatgatcaaatcaactagattactctctacctctttcaccttggcccatgagtcctccaagttatttcttaccacctctgagatgtggttaaaaagtgagcaagaactcctatgtttccctttgtgcatacatcaagccctggactgttgaaaacattaagtacctgaactttggctccttcaggaaaggctgtatgcatgttagtttataccaggtatctacccatctaactccattctttcatttaatcaataaactgcctactaggcatctggctctgtgctagctactaataattaaaactctgagcaagaaatacatgatctctgcctttatgaaggtcagagtccagcagagacataggaccataatgatagaatgtgataggcaccataataggagcaggacagggagctgcagaagctgtactgggagaacctccaggatgtcttttaggagatttaagcaacagtttctactgatgcaatcttataactgaaagagataatgattcacaaagtatttgccactatttataatactgacttgaatatgggccttatttatcatctgttctgtctattcaaataattaccttgtccttgggaacagtctgaacaggttctaatggccacacagttgatgagatcaaaattaacaaaggttgtgttagacaccatcagttcccatcttttaggagttttaatcccagatgacatacacagacttccctgtgatttaaaagaaaaaaagatgaaagcaaaataagaaaactggacacatgaaatacaattcataatgcatgaataaaaacaaagataaaaaagcgagctattgactaagagaaaatatttgccaatcacacatatgacaaaggacctatatccagaatatagaaagaactcttaggtttcaacagcaagaaaatagacaacgcaattcaaaaatcaggaaaaaaaaaccttcaaaagataacccagaaaagaaaatatacagatagcaaataagcacagaaaaaaaaaatgttcaacatcattattcactagggaaatgcaaattaagatcacactaaaatatactatgcacctattgaatgaataaataaaaatacagtgacaatagtaagtgctgatgaggatgagaaagtattaaaactctcctgtttctagtggaatgcaaaatgagacagccactgtggaaaactttggcagtttcttataaagttaaatatgcccttatcatatgacctagcaattcaactcctaggtatttaccttggagaaatgaaaacttacatttatataaaaacctgagacaaatgttcataacagttccatttataatcaccaaatatggaaacaagtcaagtgcacctcaataaatgaatggattaacaaactgcattacatctatctaatggaatactattcgtcgataataaggaatgtaatattgatatgtgcaacaagttagatgaatcccaatggcattcaggagtgaaggaagccagtcccaaaaggttacatactatatgactccatttatatgactgttgaaaaggcaaaactatagtgacagagaatatattagtgattgccagtggtttaaagcaagaggaggctgtggctacaaagatggagcaaggaactggggtggatgcaactgttctgtgtcttgattgtcgtggtggttgttacacaaatgtgtacatgtgttaaagctcatagaactgtacatcaaaaagtcagttttgctgtatattaatatattttaaaaactttaacaaaaagtctgaaaagaaagaaacaataagtgttttcatgattttccacaaaatctctttgacaaacactatccaatcaagctgctagtgcctcactgttccattgttaaaaatagtcttacatttgaggattaccagaatttttgcaatcactcccaacatgaaaaatgatgaaacaataaacaaatagcagaaaagaaactcagtggacacaaagctagtctagaaatcagaagaaaacaaaaactataattaatggccttggagaaataagtatattatatccatgaaacaaatagaagcctaaaatattatttttagaaaaaaaaggaaataggagagtagaaaaaaggaattcaatatcatagaaagtagaacaaaaagacaaagagatggaaaatcagtaagaacattaagatgagaaaaacattccaggaggcccaatatttaaataatcatagctttaaggaaaagaggaaaacataggggaaagaattatcaaagaaataattgaagaatactgtgcagaaggaaaggatataattttccagactgaaaagtcccactcagtatctagcacaatgtttagaaaaagagccacagcaaagtgcatcatattgaaattgcaaaacaccagggacaaggacaagttcctaagagctttcagagagaaaaaaaataagttacgtacaaaaatcctggaatctgagtttttgttttttggtttttttttttgagacagaatctcactctgttgcacagtctgcagtgcagtggcatgatctcggctcactgcaacctctgcttcctgggttgaagtgattctcctacttcagcctcccgagtagctgggactacaggtgcttgccaccacatctggctaatttttgtacttttagtagagacagggttttgccatgttggccaggcaggtctccaacccctgacctcaggtgatctgcacacctcggcctcccaaactgctgggattacaggtgtgagccactgaatctgagtatcttaaaactattcagcctcaagaccagaaggagctacaagatgatggaatattgccttcaaaatttcaatgcaaaatgaacttcaacctggtatcctgtaaccaacaatctactaataaaggggtctccatatatagctcagaactttcaccttccatcgtttccttttttttttttttttttttttttcagaaagttaccttagggtatgttcaaacaaaatgaggaattaagccagaaaagaagaagatgtacgaatcagaaacaagagttccaatactagacagacatgaaggaaatctccaggataatgttcaagggagattctaagatggagctttgaaacccttcttatacattgctggtgtaagcataaactctggattgttgcttggcattatccactaaagttacacgatgatccagcaattttacaacttggcttatattcaacagaaatgcatgcacatgaagaccagaaggcatatagaataatgcttatagcattattatttgtaaataaccaaacttacaaatgatgaaaacaaccaggtacaataagttacatgctttatgattccatttagaccaacttaaaaaacaggagaaattaatctatatcgatagaaggctgaataatgcttgccctttggctagggcgtgcggagtggggttgaatggggggacaagaagaggctttagaggagctgataatgttcatttatttattattagtttttattttttagagacaggatcttgctctggcaatgttctatttcttgttcttagttgtatacatatacatggttggtttgctttgtaaaaatccactgagctattcccctatgatttgtgcacatttctccataaatgttatatttccatgaaacatttaccttaaaaagtaggacaaatactagagaaaggtaacatagaagatgagagggtaaggaaagaagctaaaggagtttaatgtccttgcattacttatgtaaagtttaacagtgctgatgtaatttagactttgttaagacaagcaggcacattaaaaacttaaggccaatagctaaaataatcataacagaatggataactttcaaatgagtaaatataaaaatatgcaacacaagacaaatcaaaatagaaaagaagaaaaaaacagaaaccaaaaacggattgcaaattgaaagtgcaaaataagatggtagaaataaatgcaaatatatgggagacatcagcatgtggaaggtaattgaaaccactagagaaaatgagatttctcccagggagagctagtatattgagaagaaaaggggccctacaacagaatttagggaaacaaaaagatgaaaggtctaaattgaagaagacaaatccacaagtgaaaatgggaaatcacccctagagaaataggaggaagaatgaagcaactccatcagcatctgtctgaatacggtattttttaaagtagcatcatctgctcaaattaattacaataacaacgaagacagccatcctacagatacttcgataagtagggtgaccgtaatttaaattaaaattagacattttttttagtgtgaaagggtatgttaattagacagaatgctgggacaataggtataaacaaactacgcacccaaactaggatatatcgtcatgctatatagcacatgtctttcttgtatatttaagtcattcgtactgaaaattattctattcatctcaatacaaaggtaacattggctgtgagagtaccaacacacgtacaggtatgcttaaaggaaaaaaattccttctgatgataaaaagttcttccagaaagtaatgtttattttaggatgtgactcacagataattgtatgccaccaattatatatgagtggaaagtctaacaatggacaggccaaattctttaaaagtcttaattcctggccaggcgcagtggctcacgcctgtaatcccagcactatgggaggccaaggcgggcggatcacgaggtcaggagattgagaccatcctggctaacatgttgaaactccgtctgtactaaaaacacaaaaaatgagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccaaatattgcgcttttcagaccggcttaagaaacggcgcaccacgagactatatcccacacctggctcagagggtcctacgcccacggaatctcgctgattgctagcacagcagtctgagatcaaacggcaaggcggcaacgaggctgtgggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaggaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtgaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatcaacagaactctccaccccaaatcaacagagtatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactccatggaaactgaacaacctgctcctgaatgactactgggtacataacgaaatgaaggcagaaataaagatgttctttgaaaccaacaagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataacgaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacatagccaaagacaaaaaccacatgattatctcaatagacgcagaaaaagcctttgacaaaattcaacaacccttcatgctaaaaactcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaaaaacagacaaacagagagccaactcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatgggtaggaagaatcaatatcgtgaaaatggccatactgcccaaggtaatttacagattcaatgccatccccttcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaggctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaaggtctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagcaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaattaaaaaaaaaaaaaaaaaaaaaaaaaaaacacaaaaaattagccaggcgtggtggcaggtgcctgtggtcccagctactcaggaggctgaggcaggagaatggcgtgaacccgggaggcggagcttgcagtgagccaagatcgcgccactgcactccagcctgggcgacagagcgagactccgtctcaaaaaaaaaaaaaagaaagtgttaattcctaaaggaatggcaggcacaaaagacagaggctaaaatcagagtcccataaccacagaggtcaggaaccctctttttctttctttttttttttttttttctttttttggaacaactgacacctggcaacatagtggttcccaaataaatctgaaaaatactgtgctaagtaaagattaatagatttttttttgcttgttcactttaatgctagaatttctcagagcctttagtgtattttttcaatgaattttattctgtatatttgagatttacaacatattacagggtacacataggttatagtgaagcaaatcaacatatctattatctcacagttacttttctgtgacaagagcagccaaaatccacttatttaacaaaattccctgacacaatacaattttattatctctaatgcttatgttgtacattacatctctggatttgttggagattttgggaaatagagggtacggtaaacagcacagtataaatataattataaccaaataatcttctctttccagacactatctaagggctagcttttcatgaaaaacacttcagggaacattggtatgaacactaataaatgtcctttgccaaagccattttccatgtgcaattgaagaatatttgaccaggagtgggaggatatcagggtggtcctagctccacaatactaggcatgaaccttaaactgccattcaagtttccaagcctccattttcccctaagttcaagaagttaaccagatcatctcttaggtaatagttggctctttaattatgtggttttatgatttggataactaaccagcatctagacatcccctagaacaaaactgtttaacattttccaccaggggactcttgtcctgcacttacttaagagactgaaaggccctcagctgtactacattcctagtgaattacaccccaagggtgtgattatttttgattatctcatgatagccacccttttgtcataatttacatcttaatttttgtcactttcccattaattatgatgtctatttaacatcaattaagatactgcaacattaatttaccaagacagttactcagtttgctgggaattttgtttttaacatctactctaaggttatttctggaaaagttaaggacctctgatgtaccacagcatcacagaatctaaatctgggtaccatcctctcttgaaaactacacagtctgaaaggaagaatcatctctcaaggtggtaatccttttagagggaaaaaaaaactggcacttatttatctcctgaaaagtatagttcaaaggagattttactaagaaaagttgagagttaaatccaggaaaatgtagctcaataagaaaatgacttttaaaatcttcacatttttatctatagctgtgaaataaataatcttcaatggaagtataagaatcaaaacttatcatttaaatttcaattgaactaagcactcaggaacaaactgaagagaatattcttccttggctcccaataaatctatgatttccataatgatgtgatgactagtatgaatgtagttctaataaaaacaagaacataggggatccattatagacctgaagcctaagagaccaatggcagccaggaacccccacttaggaactagtgcttcccacccgggagtactctttgccccatctgcatccttgtaccctgagaagtcatctagagtctgatttttatcatgtggaaatccatacttaggcacatattagtgaatcacatacaaaataacgaactaggcaaatttctatttcatgatttgacctcttactatgagtaataattctaaattgcaaccaaataaaattctgtcagctacttatgacttctgtgatttatctgtactcataacactaaagcactgtgtatatatgagttctattatcaatatcaccactattacaaataaaaaggtcttttaacttttactaattaaatatgagattcactaaagaatgctattaaaattgcatatcctggatcatcagggggcccagcacatgtaattttgttgtgattgacagcctaaaacaaccacactaaggcacttaccttgtgggcaaaatgaccaagtaataagctgtcagtaactgaagtatttgcatcactttccaagacgtcaattccaaaatctctgcatgaataaactttgaagtttttcaggcgaagattgctacttctaaaaatctataaaatacagcatgttacagcaaaggtctgaggcttggtttttcttgcggacttcctgtagcttttaaaattattgattaagtagaaagaagcatgctatattgtattaaagcaccttttgtccatcaatgtcagtataggcatcctcaagttgctgtgaggtcagcactaatgagtctcctttggtaacacccctttgtacttttcatttctcctcataataaccaatacattaaaaagatcaatatgaattctccacatatctaaaataaacttggagtggccaaatcacacaaaggtaacagagaaaaacattgcatccaagaactctagtgcttaacattttcttcaatgtattatatattaactcatactgtcagaagattgcaaatatgaaataagcagctcagcatgactacagagtcactgtttgtaatttcaacataagttatgtacatatatgtttatgataacccaaacaggggtcatataataacaaaattagcttggtagagttgtaagtctactacttgctatggtttaagcctgtccccgaaaaagcatgttttggaagcttaatccctgatataacagtgttaggaggtgtgtaggttatgaatggattagtgctgattacaaaaaaaacttggggctgtgagttctatcacttgctccttctttgacttctttgcccttctgctatagactgatgcagcaagaaggtcctcagaagatgctggcctctcaatcttggacttccaagcctccagaatcatgagctaataaatttctgtttattataattttcccaaattttattattctgttatagcagcacaaaagggactaagacaccactggtctgggagacagagttgtgcttatgtttacgtctttgaccaattttttgctaattttatttattattaatacataatgactcatttgaagttaatttttgtaagtagcataaattaaggtaggatacaacttaattcttttgtgtgtgaccatctagttatacaagcaccatttgttgaaaagactatatttcccacattgaatggtcttggcatcctttgtcaaaaatcatttgtttatagatatatgggtttatctccagactctcacttctatttcattgacatatatatctatctttgtgcccatataccacactgtcttgattattgttgctttgtagcaagttttaaaatagggaaggataaatcctcttacttcattcttcttttttggtatagttcgagggaagtttacgttttaaatttgctgctattatgttacttaattttccccttattcttcactataaaagtgcaattccaagaatatttttattatttaaactttttgattaatcaaatttgagtgcacaagagttcaagttgtagttctgtatttttttccttcataggtttagcatttctgattgcagaatttcaaaaaatggctttattagcatcttttaatattttcattttactagattatttcctctagaaccaggctactcaagagcagggagacagagtttaagcccctgcaggtataaatcacttctctgcataagagggcactcaacaaatgtttccactagatttgttacccctatagggtatatttatagtgctcatgggaagcattttataaaattaaatgagaacaaaatactaaatacatttcggactccacctgttagctgtcctaattgtatatttttgggctttcttcatccacagttatctttcttttatgggatatatgaaacaaatgtttgactttcttattgtgacattattatatgtttgtattctatttcctgaaggctctacaaacatagttcttcacctatatatcttatgttccagatttctaggcagagacaaagtgtatgtaattttgtctgtattgcatcaaatagtgaccctgaataatttttacatgttgctgttagcagtgagcatgcaaagcttccttataagaaaatcattgggataatgaagagtaaatgattgaacatgaaccttttcttttcctttaagaaaaaaatagaagaaaatttagcttatttcttctaaagtaagagtggtatcttgagctagaatgtttgtgtatcaatgacgaacagtgctttttcttaagactggggcatgtattattcaggatatcgggacatcaaatgcacaacatttggagtctaaattctgcacttggttgtactactaaccaattgtgtgatctttgacaagtcccttcccgttcttagccttaatttctatctctaagtagagatggaaagaaggaatagggaacctctgtgatctcccctgattataaatctttatgattctgttgttctcttctagggttgccaaaaacacccaatggagaaaatgacctaaccctggattagtgactaggaatttgtttaacaactattctacaagcacctatgatccattggtgctttaaaattgtgacagcacagcaatgctcccctcaagggcaagtcaatcccatttaagtagatatgcataatgaattgctgtgagaaaacaagtgacagttttaattttaaaaacaacaacaataacaacaacaacaaaaaagcttacctgggcaccacctgcactttcccaaactgtgaagctctggaacagagtggtgccagtgacattatcccaaggtggctgaaatttagggtatacaaagagaccatacctaaaaagtgaaacagaatgaaattaagccaatttttatgtttctaactttctactttttcttgttgaaaaatacaaagtaaaagtaatgtattagggagaatgaaggtagatggaatctgtgaccctccccctaactgttcttgcctacccctcagccctcccacttttaccctctgtgacctgctcccgaatcccaacaaaatgcagattactccagagcccaagcctagcagcctcccaggggctctgcatatttggaagtttaattgctctctctattgaattatctctggccacaaaaggtacattctgtccttctgccttttcatgtgactctcttctctttaccatcgaactgttatgatctagaaaataatgctaacacaattatatacaaaagccaagacatagaggcagccaagatgtccatcaataggttaatggctggggaaaatgtggtgtatatttgcaatggaatattattcagcctttaaagagaaggaaatcctgccatttgtgacaatacagataaacctgggggacactgtgctgggtgaggtaagccagacacagaagggcaatagtacatcatatcatttaaatgagaaatctaaaatattcaaacttatagaagcagagagtagaatggtggttggcaggggctggaaggaggggaaaatgggaagtattagtcaaagggtacaaagtttcagctatgcaaaatgaataagtcctagagatatacagtatggcaaaatgccaaagtatagaatacagcaaaattaacaatactatattctatacttaaaaatttgctaagaggtcagattttgtgtcaaacgttcttacagtaataataataattcaaataaagaggctctggaggaaaacttttagaggtgatagatatgtttgtgacacagatggtgatgatggttgcaggggtgtatacttatctccaaactcatcaagttgcatacattaaatatggacagctttttgtatgtcaattatacctcaaaaaagcagtttcagaaaatgcacaggaacatcacccaatctccaacaaatgcccaaagtgctctcattgtgagcattctacagtaaaatgtgaaatcataagacagccaaaacatagatgaatttccccaaagttacctggtacaagaatgtgcaatgttctgagtgaaggaaagaagcggagcttgtgatgtttggttggtcatgagatggaaaaagtagccatagccagcaccacacactctgttcccctacagaaattaagaagagttaaaaaatagttaccccatgtatgataaggttgctggaaagaaagactcttgtttgtactcatcccaattttatattcactttctgccaaagtacattaaaactctattatagactcatttattctttttttttccttttgggaacaaaaatagtgatatggtttggatttgtccccctgcccatatctcaggttgaattgtaatccccagtattggaggtagggcctggtgggaggtgactggatcacggggtcagtttctcgtgaatggtttagcactgtccccccttagtactgtcctcaccatagtaagtgagttctcatgagatctggtagtttaaaagtgtacagcaccttgtggctcccaccttgtcttgcctctgttcctgccatgtaagttgcctgctcctgctttgccttctgccgtgagtaaaggctccctgagacctgagacctccccagaaattgatgcttccatgtttcctgtatagcctgcagaaccatgagccaattaaacctcttttctttataagttacccagcctcaggtatttctttatagcaatgcgagaatgaactaataaaaatattgtcattcttcttcctccagccagctcaactagactgcaatttgcccatcttaataactggtatctcatgctcaagcctctttctaagcttccacagtgagtttactcatgacatctaaaattctcctctttggtgaatgcaacagtatatggtagctctccaaggcaaaggtgtaccttgaagtcaagcctacacaatgtgttctctctggctctttgaacaactcaacgatttgtctattggctgaaggccacatgattggaccagtcatgacttagtaccaagacagggtgactgagtacaactacaactcaaatctcttcaaagtgctcttgtcctgaatagactattaagtcgccttgatatttctttataggtcttactatctaaataatttcatgtattttatgtgttcatataaaatctgacttctctctcttggaccatatgagtttggggatctaattctgatcaaactgaacacaatgaggttatctttataaattcaatgaagtacctacaatatgttcatccctatgtaacatagacttaagacaaattaaaaaactgacttcctaaaggtttaagactgtacacagatgtatttttttttggcctacccaatgttcatatttttttggttccaacatgttcaaaccaagagatttaataaaaaattcagactttcagcttttctgagcccaaattcctgtgaagtagccacaggtcaggtgaagataagaagggccttccttcttggactgtggatgatttttccacagtcctcacccttcctggttcactcatttatgatccctgcctagtctctgcagtatttgaatttgcaacctcaactacaggcaacaaagtaaataacatgttggctattctatgaaagtttctatttctgctttcctgaatcacatctgagttctctcagtgtcacacgctcacatcttaaggatcccaagccttctctttatcatcagggagaaagaactctgagaaaaatcggggccctatcaggctgctgcactgcagtgatgctattagtgggaggaacaaagggccaatcgatcaagctatgagactacttcctatgtgcccacgtgcatctgacctctctcagtctgagtggttgtccaaagtcaagatgcccatgtctacctggagaacagaagttaaggaataggctgctcaggtgtaagccctgtgctacatagatgaagggagtctccaaggctcccacatgattcaatcctgatcacctgggggttttccatggcctggctggtgcgagacaaggaatgtctggagtatcctccttggaagtcactcaatcccgggaacacaaactatggggcttggagagctcatcctgaacactggcattagggtcacagtaaagagaatggggagtcataaggaccatgacactgtgccactcaacaagacattaaatgcctttctttaaaaaacaatacttcagtgcagccctctatgcagggctcagtggggactacgctgtgagcatccccttggaacagtttcttaaactttcgtgtgcaacctggtagagttgtcatatttagcaaataaaaacacagaatgcccagtgaaatttaaatttcagataaaaaataaaatattttagtataagtgtgtcgcaaacactatctgaaatttaaatttgaccaaatatgctgtattttatctggcaggctttacctgggggtatattagccaaaggtttttagatattttgatttattaggggggtgatgaggaagggatgagggacagtattctttactcttggccatcacaaggtgctctgataggtctgctgcaggtgatattttgaccccattttgagaactacttctctacaggtgattgagagagtaacgctaagggttactaacgttcctaggagacattcaaagaggagagagacactagaaaaaccacttcctggtgaagttttttgccatgagttgctttgggaacccactgcaaatggaagccactgctgaaaactgaaggaggatagagacctagaaatcagggggagaatccattgccaggtacccagcaaaaatgctgcccagctcagtgcaagttatatttatggtggattttttttttcccttagaagtattttttttttaagtaatgatgagtagaataataacactcatagtgaaaatctacagagaaggcactacagtccaggtactggattttagagtctcatttatttttacaatagttttatgagttttgtattattattacagtttcatagcaaagaaactgaagctcagagatgttgagtaactttcccaaagtcacagagcaaatagttgtcagagccagctccatccaagtccaagtctggaaaagttagagactagagtagagaaatgaaggtaggacccaaaggcaggatgcccaataatagggtgcaagtgaagaaacataaacaagagagtacaaagaaaagtcttgtcacccggtcacggacagaacaggcatttgctgtggcctccccagtagtggagacaacatattgaacaacatcctttgcagaagtcaatgtatcatggacattcacgcaagggaaattccagagagaaattaactgtccaagtaagccagctcctagaggtgtgcatctatagtcaccagaaaaaaaaaaaaagtgaattaatccttaaggcaccggaggtagtgtttgatttctccaaatctggagagcatcttgcaggccagatttaactaaggagttgctcttttcacaccccaaatccagagaatgtaaaatccttctcattctcaccacatggggaaaaaagcatgcacagcttagcgtgcacagagagatacatgggtaggggtgtgggacatttctcaagagtaggaagaagacatgacattttgaagagtacatttaaggaggatgagggttctggaatttcagcattatggagatcaagtgttattaaggctgagacatgttgatgaggactggcttctgacacaggaattttgagcaatgacagatgaaaagactgagattatctgcagttgtcatctactatcagtgcagacagtagggctatggactgaatgcagacaagggttagaatttaatgaggaagttctgacccatccaaggacagggtcttgcactagcctttcacacagctcagggagttttactacattctcagtaaggatggattgagagtgaggactccatacccttttacttgtagctattctccatttctttatccttagactaagtaaactcatttcatcctatggcttcagtcattctagactaatatttttattgactttaatttccaaatgaaaggaaaacttcaggttttggggttttgtttttttgtttgtttgtttgttttcttttttgagatggagtttcactcttgttgcccaggctggagtgcaatggcacgatctcggctcaccgcaacctccacctcccggattcaagcgattctcctgccttagcctcctgagtagctgggattacaggcatgcaccaccatgcctggctaattttgtatttttagtagaaatggggtttctccatgttggtcaagctggtctcaaactcccgacctcaggtgatccgcccaccttggcctcccaaagtgctgggattataggcatgaggcaccgtgcccagccaactttaggtattattaagggtaactctctgaacatggctgatccactggcagtgataatatagcggcacccccaacaggagaagaacttaaagaccctattccttcctgaatgtaccacatgttccacaaggaacacacacacacacacacacacacacacacacacacattcagccaagcaaagacagtatgggggagaaaactgaaaaagattgctcttaacccaataacgcccaattccctgccttgtgtgacagaaagaaccaatgcctcaacccctggaggccttcagttttgggggaagtgtgagtcagggccagagttccccctgaaactagaagcctgaccagcaggcagcagccaggacctggtcagggaggccagcacatactgacacaattgccccgggctgtttatttagctttagcttcaattcactgtgggtcccaaaggttcttaccctgggtatttgtaaatagacagccatttcttcctcatttttcattcggttacaggatgttttgttcctttgtggactaattggccgagtcactcctgcacttcattattttggagtctgagcaattctccaatttcctaaaagcacttagaattctaatcacatgtctcacctaccacagggtgctcaccaaaagtgacttttggatatcactgaatattaagatgaatcactatcaaagatgccaacacgacttcaaagaatcaggtccatttctaagacttcaatggtcttagggtggcctagtctagagtggtggttgtcaatcagggatgactttgttccctacggaacatttaacagcctctggatacattttttattgtaacaacttggaggatgaagaagagagaagagggctactggtattcagtgcatagataccagggatgctgttatacagaggataggctcgacaacaaggaattacccagcccaaaatgtcaatattgacgtagttgagaaaccttggtctatagtctacactagagtcacatattagcaaaataacccacactcattttccagtatcccatctccaaattttgatggaaagacaagcctaaatatgaaaacatggttaattacaataagaatgctttaatagtctttactaggaaactattgatatcatttaaaaccattagatgaggcatcaggcattcccattaaaaaaacatttattagcattaaatcagctatctcaatttttctcttgtgctagaaaacagagtatgcactcctgcttcttggcctcaagaagaatcactgtctattagttggcaaatataagtgcccagtgtatctcttcagcccttgtaaatatacaaagaaataccacagctgttgttctcagtcacgattacacaacacaaactttccccagggaagtgaaactccaccttctctaggtgtgtctctctatatccacgagccttgggaaaggtcagcggtacataagaaccgagggccagagaagggggcttcttaaacacccaccttgtctgcaagtatacaatgagaaatgtggactggaagctaaaagtgatcatctcacttgtccacacagctctatttcattaccaaggaaatgctatttcattaccaagattttatgaggaaagaaaagattcttaaatttaaaaaatatattccaaggactgcatccttattcatcacctttgccagcacagatgctcagaaagcacgtgtttccctgaataaatgggtttgttgaatcatctgccctagtgccattagcatttatggcacatctgggtgatcacatataaacactttccaagcgcatttataggtgggcaggagactgcaactttggtcctctgttagctgataagactcacttttcttacaaaagaagcactttaacagtcagatcgcattccttcctggcccttcttactctcaactccaattgtgtatgctacaaatgattcatgaggaaaaaccacatatttatgcaggcagctggcagcttgcggggaaggtttaaggcaagcagggaattttgtgtggaaatcaattatttgcggaagtcaatgtattatggacattcaagcaagagaaattccagagagaaattaactgcccaagtaagccagctccttgaggtgtacatctatagtcactagaaaaaaagtgagttaacccttcaggcagctcttaaatatgcattacctattgagtggggaaagcttgagaactgaggttgggcctttaaacagaattccttacaaaattgattcacaaaccagaacaaattctcctcaaattaaatgcatgtctccaaagggctcttcttcagagtttttccacggactatcctaaacaggggtctggttataggaaatttccaacacctacataaacatgggagactctgagctctggaagtgaacagtcccttgctgtttgagagcaaagacttcccaaccagagagaatgagaacagattcacacaggttatgtcttctggaaagatgcagcctcttgacagataacaaggagctcctgtcaaagaagtcctagactccggagctggagctgctgagggaagacagcctgagggtgaagcgctctaagaagctacaggtgatacacaaaagaaccaccaccaacttgcttttggaaagcatggcaaacgcctatttaagaaatgtaccagggaatgccacaggcccctggagactcaagcacttatcacccatgggtcctcactggcaagaaggtacaaagctcaggttttgcttctcagtgaaactgccctggactcacctcagctgcaggctgggcagggagagaagcagaccacctgtgaacatcaaaactaaaaaagaatatcatatttgaaatttacttgcatcatgccaggttgaatgtaagtgaactagcaaggtgactgactgcaagcccagctgaattccttatgttgtggctgagagtttggtcccagctctgcatcagggcaatttgagaataatataaaaccacaaaccattgcacagacttaagaatcatttcccctgcctacctaccttccaggtcagagatttcaaggtcagactcaggtatgtgaggagagagagtttaggctttcagagttggttgcccaaacatgaagattaggccatcttcttcaagtctaaataaatacatttgtttaattaatactatcataccaatgtcaatgtcctggccttggtacagctccatgactatggttatcgttatgttatcattggagggagctagatgaagagcacataggaattctcttatttatgcagcttctcgtaagtctgaaattattttaaaattaaaagtttaaaataacaacaaagaaaaatcctaattaatcacaattttctatcacatctctttctgttccacatattatacacatacacacaaatacatgcacatacatacacacacaccttgttattgtggaagcctccttattatccctttggaataaaggtatatttctaaaatatgttcttcaaagtactctgtatatcatccatacaggacacaattaacactaactcagccaagaatggtggctcacacctgtaattccaatcctttgggaagccaaagtggggagatcacttgagaccaagagtttgagactcgcctagggaacacaggtttttttcacgtatacccagttaccacctatgtctttaagtaatggcacatcacagacaatagaatgcaaaaaaagactgaataacagaaagccaatggcacaactgaaaaactggactagactttgcaagatttaatgctgatagcccaacagaatctaaatgcttccactgactaaacttatttttcagtcatcaaaatgattttagaactttggaacttgttctttactttcctttttcttcccccacataatttggttataggtttataccttcattcgttatattaaatacatttttttttgagcaactaccatgttttagaaattgtgctagtgtctaaaggctaatgaaaatagaattagaactttaaggtcaccggaggagccaagatggccgaataggaacagctccggtctacagctcccagtgtgagcgacacagaagacaggcgatttctgcatttccatctgaggtaccgggttcatctcactagggagtgccagacagtgggcgcaggtcagtgggtgcgcccaccgtgcacaagccgaagcagggtgaggcattgcctcactcgggaagctcaaggggtcagggagttccctttcctagtcaaacaaaggggtgatggacggcacctggaaaatcgggtcactcccacccgaatactgcgcttttccgacgggcttaaaaaacggcacaccacaagattatatcccgcacctggctcggagggtcctatgcccacggagtctcgctgattgctagcacagcagtctgagatcaaactgcaagtcggtagccaggctggaggaggggcgcccaccattgcccaggctcgcttaggtaaacaaagcagcccggaagctcgaactgggtggagcccaccacagctcaaggaggcctgcctgcctctgtaggctccacctctgggggcagggcacagacaaacagacaacagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccaacaggggcacactgacacctcacacggcagggtactccaacagacctgcagctgagggtcctgtctgttaaaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgacgagctgagagaagaaggcttcagacgatcaaattactccaagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccatgcgatcaactggaagaaagggtatcagcgatggaagatgaagtgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatagagagaacgccacaaagatattcatcgagaagagcaactccaagacacataattgtcagattcaccaaagttgaaatgaagggaaaaatgttaagggcagccagagagaaaggtcgggttaccctcaaagggaagcccatcagactaacagcggatctcttggcagaaaccctacaagccagaagagtgtgggggccaatattcaacattcttaaagaaaagaattttcaacccagaatttcatatccagccaaacgaagcctcataagtgaaggagaaataaaatcctttacagacaagcaaatgctgagagattttgtcaccaccaggcctgccctaaaagagctcctgaaggaagcactaaacatggaatggaacaaccggtaccagccactgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaagaccattacataatggtaaacggatcaattcaacaagaagagttaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaattcagctctgcaccaagcgaacctaatagacatctacagaactctccacctcaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatggagacacaaaaaacccttcaaaaaattaatgaatccaggagctggttttttgaaaggatcaacaaaatagatagactgctagcaagactaataaagaaaaaaaagagagaagaatcaaatagacgcaataaaaaatgataaaggggatatcaccaccgatcccacagaaatacaaactaccatcagagaataccacaaacacctctacgcaaataaactagaaaatttagaagaaatggataaattcctgaacacatacactctccagagactaaaccaggaagaagttgaatctctgaatagaccaataacaggatctgaaattgtggcaataatcaatagcttaccaaccaaaaagagtccaggaccaggcagattcacagccgaattctaccagaggtacaaggaggaactggtaccattccttctgaaactattccaatccatagaaaaagagggaatcctccctaactcaatttatgaggccagcatcattctgatacctaagccgggcagagacacaaccaaaaaagagaactttacaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacagaattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacgaagtcaaattgtccctgtttacagaagacatgattgtatatctggaaagccccattgtctcagcccaaaatctccataacctgataagcaacttcagcaaagtctcaggatacaatatcaatgtacaaaaatcacaagcattcttatacaccaacaacagacaaacagagtgccaaatcatgagtgaactcccattcacaattgcttcaaagagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttacagattcagtgccatccccatcaagctaccaaggactttcttcacagaattggaaaaaaaactactttaaagttcatatggaaccaaaaaaagagcccgcatcgccaagtcaatcctaagccaaaagaacaaagctggaggcatcaccctacctgacttcaaactatactacaaggctacagtaaccaaaacagcatggtactggtaccaaaacagagatgtagatcaatggaacagaacagagccctcagaaataacgctgcatatctacaactatctgatctttgacaaacctgagaaaaacaagcaatggggaaaggattccctatttaataaatggtgctgggaaaattggctagccatatgtagaaagctgaaactggatcacttccttacaccttattcaaaaatcaattcaagatggattaaagacttaaatgatagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaccccatcaaaaagtgggtgaaggacatgaacagacacttctcaaaagaagacatttatggagccaaaaaacacataaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaaatcagtgtggtgattcctcagggatctagaactagaaataccatttgacccagccatcccattactgggtatataaacccaaaggactataaatcatgctgctataaagacacatgcacacgtatgtttattgcggcattagtcacaatagcaaagacttggaaccaacccaaatgtccaacaatgatagactgcatcaagaaaacgtggcacatatataccgtggaatactatgcagccataaaaaatgatgagttcatgtcctttgtagggacatggatgaaattggaaatcatcattctcagtaaactatcgcaagaacaaaaaaccaaacaccgcatattctcactcaaaggtgggaattgaacaatgagatcacatggacacaggaaggggaacatcacactctggggactgttgtggggtggggggagtggggaggaatagcactgggagatatacctagtgctagatgacaagttagtgggtacagcgcaccagcatggcacatgtatacatatgtaactaacatgcacaatgtgctcatgtaccctaaaacttaaagtataataataaaagaaaaaaaaacttaaaaaaaaaaaaaaagaactttaaggtcaccaaggataaatatgtcaggaatatacctaatgaatctacattaccagtttaacctaaaactccattctcaaaacatatgcattgtattttttttctaattttgtaaagcagatacaagagtaagaaagtaaatgaagggaaatggaaagcgttggagggagagcaagcagctagttgcagactcaatttttccattgctgactgggtattattctacaggtcattttgcaaaggctcacaccacccacagcttttcagattaccctctggttctctgcacctgcagccagctcaacccttcttcttgtcagccagtggccagcactccgtccagcagaccacatactacccagtgagacaaggacattccagcttcacacagcagggtgagctgggcaaccctgagggtttactttcctccaggcatttgatgtagtcaacattatgctacccagaaaagtacacaaaaacatggtttcttaagcccaaaagcttacagacatagaaagggcacataggaactcttttatttacgcagcttcttgtaagtctgaaattattttaaaattaaaagtttaaaataacaacaaaaaaatcctaattatcattaggatttttggcctgtagtgaccaacaagttaaatgcagctccagctgtcctggatctgggatctgggttcctacagtccgtgtagttctgcttcctttgcttactggcatattagccactcccattaggcacctaaaatggtgtgtgagtgctgtgcttggaacaaacataattaagaatctaaggaagaagagataaccactacttttactagggtttattcagctgaaggtaattaaaaacagatgatcagtgagaaagaagctcatcctctgagttccttagaaactcagcataatgacatagtggatgctgagaggagtttcctgaaacagtgaggcccttaactcctttgatagaagatccatgggataaaataattagaaaaggggaaatgaaatggcttgccactactctgatgcacttgttcactcaggtctacagctacattgtcccctcaaaaattaatttcttaaatgtttaaacagaaatgtgccaagggaaaccaatgttaagttgtactaaataatgggattttaaaaatcaaggttattgaagtggacttcatcctcctggaatctgacatgaccttatacacctcatgtctcagttttgaacactcttaaaggacaaaatatggccacattaacatagtaagatagtgaaggtttaaaaagaaattggtattggaatcaagtgagacaaaaatcagcacccagagttggtagttcagggagatattttagtttgcattacctagatgaccaggaaacgatcaatatctactttgttttgctccattacctattgcttcaaaaaagtgtttccagaaatcctgagaggaatgcttacatttatcctaaagtacttgtttaatgcaaaattataaattattttcttgatactaatatgcagcaagtaaacatttcataccacaccaccactaacgctgccaccttaaagaacttttggagcaagcttgtccaactggcagcccacaggtcgtatgcagcccaagatggctttgaatgtggccaaacacaaattcatcaactttcttaacacattatgagatttgttttacaattttttttcagctcatcagctgtcattagcgttagtgcattttatgtgtgacccaattcttccaatggcaattattcttccaatgtggcccagggaagccaaaaggttggacacccctgattgagaaagaactttatgccctctcagttctggtcttcctggtagagctgaacatcttacctctataacattggtgggactgcagatatagatgccagatggtgtcaacatttcaggattggagagtccctcggcaccagaaacctggatgatcacgttgtttcttattatatttccatgtcctgaccagtctaatgtttcaacaaatccaggggatccacaaacataattaaaatgtactcaactcaacacccttgattctactaatacacatcagagttcacataatgcatttcatatatatatatatatatatatatatatttagaaaatatttagtatgcacaataaacttaagagacctaacattttgccatcaggcttgtctataaaatatatgacaattttaaatacactgtaatagatttaaaatcaatttacatatttaccatctttccttccatgaattgcctcccaggagatatatctcatctccgtgcatgtccctgagaacaaaagaccccattacttgagtatattttatgtcacttaggaaaacaagagatgctgcaacactacttctttgggtgtgggttgttttgattttgtttttgtgtttttatctgtaaatcagggaaagagatacagatcttatgtactcttcagttctagagtatcaggaatcagaagttcattttaaataaaaagaacagaaaaatagatctgttttacttttgaggaggagtctaagtgactatctccactgttaagtgccacatatcctgtgtcaacaccaaccccattcctagctgttcaaactggccacctgctatctgcatgccctcaccttcccttggaagatctgaaatgtcctgtaggaacaggatggacaacatctaggaccttctcacccaaaccactgaggttggaatagaagagcaagcatgggccatgctaatagagaaattagtcacttaagggctatcaataaagagctgccccaaagaacccttcattacaaagtctttaagtatctaggcttcctcatgccatttcatgggtctgggtttgcatacttgttatgtgtgagattgagtgctttacccaccacacatcaataaacaaaaattttaattccctcacttgtaatacaatagatgtcaaaatcttataattcacaacattcaagcactaaaggctaaattctgcctacaggttttcttccttgcatagttaatatctattccacataattgttttctgctaaggtaatactgttaggatacctttctcaatttctccttgatgtttcaccttttcccttgcacggacaaacataggaacaaacaaagtcaatcctacatctgttagttgacttccctgtggctgtccttttctaatcaaaagatttttctgcacctgatcacctcagttacccttagtttttgtcttttagagctagagtatgttttaaagcaaatgtatctgattcacattttctcactagacagtttccatctcaggatagaacttttatagcttttatctcaacagattgttcttaaatgaaacatgtatttttcccactgatgatactatagaattaaatatcaaacggtatttaacaaatacagttatattctcactttcagtgaaaacctctgatttgcttttttattctgataaaactggagaccctttgtttcttaattcattcatttctttcaactaatagatctacaatgcactagttaatatgctaagtgttcaggagacaatgtcctcaagaaatccggtggtataaagacattaatcagatgaccagaaatgtggtatataattttaaatcaagaagtactgattggcgcttaaagagcttaaacagaaggacttgtctgggagagagaatgttgcaagagaagagtaagtggcatgaacagagccagagagcttgtgcaaagaccctgaggaaggaaaaagtgtggtcttttgaaggaactaaaataaaatattttaatgtcactagagtatggagaaagagaaaaaaaacaagacaagtttacagaagttaacagagacaaaatcactgaagggatcttttaagtctggtgaaaagtttgggattctattttaaaagcaataagaatctcaaaggagagaagtgatatgatgcaatctgagatttttaaggataattctgagttttgcaaggggaatgaactttaggaaacagaagtagatagagttgatcagttgaagattctgaaacatgggcttcttcagcaagccacaggagcttgaattctattaagaagagaattccagatttttaaatccttggccaacatccaagtttgacagtctgtaagactatacaaagacatatgcatgtgacttagaattattgtgaaaattactggtagtaaactttaaaacttcccattatacacttattaacctgaactaacctttaaaagatcagtatcctataggtaaagtttagtaagccaatcagtgatgactacatttaaatttagaatgttttactgtagcccatttctagtgatcataaagccaatatttttataaattaggaattagaaatttggggagaattcattgtgaaaaactgtgtcctacacaagaatgcagaaattcaacaagcttgttttacttaccaactagcagcgcatgacctaaaatattgtagaatacattactgtccaccttcaggcccaaggtcccgcacatgctgaggcctctactgaaggagttcctcactgtgcagccctgtatgaaagactctgaataggaaagagtaaagtaaaaattagatatggctcctgagattctgttgaccatatttagagcaacctacactgtagctaaagacattctcccacacaataatgaaactcaggagataagaagttagaagcagcaatcgaatcaagagaatgagtaactcaaaccaatgggcctcaataataaaaagggtgaaattcaacaatcaagtgttagaaaaaaaaaaacaatctgagaaagacaaagtatgtctaaacaataaaagaactcatggctgtcaagatttccaactggctatcatctttagtatcagctttcatcataatacagcagatgagaagttaaggataacgtgaagagcactgcttatgggccagccttgatctttgaaacctggagcagtgaattaatatttataatttatcaggcaataatattcttggcccaagatagccagagactcattcctaactgtaagcaaggtcaaaggttggcctgaggatcatgactctcacatttgaactggataggtttatacaactaaagaggaagctatcctctactacgctaaaaaattgacaattaggaaaatcattacactggttccataggcatattctatgatccccagatctggttacgaggcctagatgagtcaatgaatacacaattactgagtatcaactatatgtttcaggaattgtgcattgcattgtgctggaaacataaagatgaatgaaactaagtaacctctgcattcatgtatttgcattctgatggaggaaactgacattaaaataataaaaatccattatttgaataattaaactataaatcctaaaaagggagctttgtattattactaggtagtgagaaagatacagatgccaagtgctgggatattagaaaagttactttagtttacagaataatttgacttttacagttgggactatccaaaaaattctaaactttaacatcactatcaacactggatctccacattcccctcaatctcagctctcctactactaggtgccctcacattgctcatcaaggatccaccccaataaattaacccatccatatctacttctgtagcaaacactgcccatagtgcacagaatcttcaccatatcacccaaacagcataggcctgaccatgtgaaaaaccagtaagtacttatgtgtttgtgtagctcttatgggcggaatactgggattagtgaacctttaaaaagtactgtgcaacatttacctatgtaacaaacctgcacatcctgcacatgtaccctagaacttaaaattaaattaaattttttaaaaagtactgttcaaatatcccaatgctttctaactctggtagctgggagtaattagctgcgtaggacatgaggggcttcagggtgttaaacaataaaagattccttaatgagcattccaaaagtttctagcctctgcattttaacagggatttaaaggtaataaatgtattaatgcagtaattttcaaacttttattttttaagcactgaactctttttcaaataaaacctaaaatataaaatatctataaaaatagatgagtgtgcagctactctgattgaaacagaggtgggagagataggttaggtaaaatttgatcaaggaagggctttgattatgttcaattgataacttatttgtgacagctaccctcttttttactgaattggccgcatgtcaaatattctgcagtactatatacagctgaccaaagaaccagagagaaggaaataaagatactaatcaatccgaagcactagcggagaggccatatgcggagccatcctctgaaatgactcaaataaatttaaaaagattggaaaaattagaagaaatagacgtccttagcatgcagataatttgaaatgaaggaaaatgttgcttctggcagttcagaatcctgccctcaatgacctgaaggattactctgcaattacctgttagaatcctagcatctctcaaaagccacctgaaccacaaagtatgccctgatgtcctttgtcaggcatcaacctctgaacccctggggcacagcctctttaaagaaggcaaagcttgaatgtgtgggtgttgaaagtgctgatgaatggggaggattactcagaaatggagctgctgtcctcctgacttggcatctgcacccccattctgtgattctctgcatgtcagcttttggtaatgagtttttgccctggatgttcctacattcaacttttattttagaacttttatcagtgcatttggtcatattctgtttttctgattctgatcttgtttttcacctagttgttctcacctgaatttgatgtttcctgctcccttcttatatcttcatgtctggccaagatctgcacatgtaactgctcctcatttccagaaaaagcacctgggtttcagcccattccccctcatttccccaggcaaaagattcctctgatttaggacaactttacatagaagtgcctggactcccacagtgttgataatgtaatgccaattcacctgtagtcacaaagctagtaagtggtagagacagaattcaaaacacaggattgtgtggttcactcttgtgtgctgtattatagtgatagttctcaaactggactccttggactgcctgttccagaatcaaaaggtttgtatttaaaatacacattcctaagcctaccttagaccagaatttgttggggtaaggtctataactctgaattttaataagctccacaagtgatttgtttaggcatactgaagtttgggaaccatagacctagaatataacaattatccatctctaaatccctcaaatcccacatatcatctatcattccaccatgcatgtagtgccttaaacatgggagaaagaaacatgagaaagtcctaggtccggacccccttacctctcatagctcccaccagagtgagtgagctcagatgcttatggaaggcttgccccaagacttgaaactgcactcccttcaactggacctggctgggctcttctgggaaggactgaacgatcactctggctcccatatccctggatcctagcatcttctcactcatggaatacaaacagtgctgcagattacctgaaatgcaaaataaagtccagagaacctaaagcatgtagaacatgcttccagacaaatctcccagtttgaaaggtactgtcagcaccgaggaaaaaccattactgtttatttcatttaataatcttatttccccttttctttgattctcctctgtatattattaattaaaagatctgataaacaggacatgatgttgccttcattctattttttcaagaaactcccaaatcaatcaccttaattactgtcacaaagagtcagactataacccacaaacccaacctaaatagatgcttatttcaatctaaaagatcctctggaggaaatgtgcaataaaatgaccttcttgtggttgataattgtaggaaagacatgttagcactgaatataataacagcactttttaatcttaagctgtccaatgaggtttccccattactgtgctgttttatggtttggggacttagcaataacgctaccacagaaatgtcaaaggactccagagaagcaactgagcagctcctgcaccaacacctacttccccagctgtgccactaatgaggacagcagcaacctgagcctaacacacacaactacaaatgccagtgaggacagcaaccacctgaactaacacacacaactatgaatgccagggagggcagcaaaccacctggacctaacacacacaactactattgctaccaaaatgttgtgacctcaggatccagggcaccttctgttgatacatggcatttggtggtacaaactaatctggagaataaatcatctctccaatggataataaagatttttcatgttaatgatccaaagaagcaccaataatataaaacactgtatcatatcacagtaaatttcagaatccaatcatttgctattacccagagaagaggtgaatgaagagatatttatatttgtatgccttatcacaatttgattatttgtgccactgatccataagattttcaaatggacaggccttgtgttattaaattcagctaccttgttccacactccagccccacacagaaaagaaatgacttattttgagaatattgtagttgtatttacgatttgtgatgcaatcaaggatgttttccatttggggctaacagatttataatggcttaaacctagaagcatgatctcactggcagcatgatcaaatgcaatatttggcaaaatatgatctcagaataccaaggaagtttgaatagaatgtagatcccaattctgcagaattgataaagttgggcagttgatggaagtgaacccactgttatccaaacattctttttagaatgacacatttgtgagtagatgatttgtagggagggaggtgaggccaaactgcctctctacttctaacaactccccacacccaaccacatggcaacattttactcacatgcacctatatttagacacaactcaaatctttaactccagctccctttgacctttcttccaggctccacacattaccagacatctctacacagttggctggcctgctggcatctcagttatgacatatacaaaattaaactcacgattgccactctcccaccccaaaacctgctcctcttcccatcccagcaaatagcctcatcatccatccagagctcatgcctggaagtcatccttgacacccacgccatcctggaccaaagttgacaaatgatgtcttcacaacatgtgaaagcctcataatctacagcctgggaaaccaaaacatgacctactaaactaaccatccctgaaatagatgcttaataggcacatcaatgtgattcagtgcctgctattctactagaagataaattgaatttttccaccacttacctaaagtatgtggtagttcactcagaaaacaaatcccaaaatggggatgggggagccctacaagtctaatcagtaagaatgtgctgcctgagcccagaactctggcatatggctttcctgagaatcttagaagtggcctggaattttaacattgaacccagaaatgtaattcaactcttcagatttagttctttaatagaaatattttccccagagaaataatattttatttcttttgtcttttgttatctttttcacaaggttgttgggcagtggggcagagaggaggatgaaatgacaatcaagagcattctgaaaactacagaaaagtatgggcatccaaagtttaagggcttattctattttaaaagaggtcaaccacagcaatgccatctatcatcagacagtaagaatattcttttttgctcattagactttccaacaaaacactcttctaccttctggagcattggcctcctggcatgaaacaagcagcttctccctctcattagtgagatttccttgtatggtaatactcctgctgagcagagccacagtggcctttaaaatatggtgctctccagccacccaattctctgtaaagttgtgagaatatctggagaaaaaaagaggatgatagaactgaggacatcactccaaatcttactaggaataataagccactagattaacataattcttcctttggggatctattcatgtttctttagaaactcaataccaaatagtgaactatagacacaagtacatgaaaattagaaactatgctgatcattgccccaaacatttgtgtaagacagaagttctagagacaagacaaactaacttacaaagtctaaatcttcaaaacatttcatgctttttaattttcttgtcaaaatgtctaccattatttaagcagaagaaatatatcattgaaagaccccaatacaaatgtccagaccccaatacagttaagatctcatcttcttccatgtcaacttagccaagctgacactcagtacctcaaaggtgacttaagatagaggtctgtatcctgcacagtttccacagtgacaatctcttccatcggtttggcacctttaacacctgttccactgatgatgacaacttcatccccagggttccagtccacagcatcttctaaagccagcactgtgtctagggcatgggcagttgctctaagacaggtgacaattacttctggtagtgaacctaaagcagcccgaggaaaagttgtccagataatttaatcattaatcaaaacgtgattaatttaatcattaataaatgtgatgttatttagccaaagaatcccataaaataagacctggaaaagcaagcttcaggataggtaagcactaatttttttatattagttttgttttattttgtttgaccttggttttctttttatctataaaaagaagtcaataaaagtaagccagactagagaatagcaacgtgtaaaaagcacaagaattgtggtcagattacacttatatttgaatcacgatcttttcatattctaaccctattctttagggtaataaacttgatgaatgggcttcagtttcctcagttaaaaacagaagtagcagggtcttccatcatagggttttggaaggattcaatgaaatagtatctatgaaacatctagcttggatcttaccacataatagaccctaagggtatgttagtcctttctcttccttttctgtgtcacactgtttgaggatgaaattttaccacctcttttttattccaagaaaaaacaagtggttattagactttctgatgtagacctccataactaatttccaatatgaagacttcacaaataacaaaaatagaggggaaaacaaaaattatctcttagagttgtcataagtcttggtgtattaaatgatcccttcaaactctaaaaactagacctatctaacataggactgctaaatgcagttgaagaaggggaacttgtggttcaagataaactttgtttgtattacactccagcatacccgcctgaccatccccataccagcatgctaatctctaattatcaaagattcaagaaggtcatctgtctcacagtttattctggtcttttccagcaagggtcaaggcacagattttttcaaggcattatctgaatacttcagaaaacacatggcttactccctactccttcctctttctgtagtacatttccttcctcttttgcaatggatgataatttacctttagcccgcagcaagttactgtcctcccttgttgtactaaagtaaagtaataatacttgaatctctaactacagaggtggccgacaataaatcattttcaaattattttaaactttcctctttatttatttgtctctctgtgcataagcacttgtaccaataatgttctaggtttagaaaggtctctgggttaatattgtaatttctgaagtttacttgggcaataattttgtcttaaaaaaatgtacagagttcaaaatttctaattataaggcaggtgaaaattaagacataaatcatcccaaaagaaaataattttaactttatttcttgtttgtatatcttaacccttggaaacaataaaatgaaataaaatttatttatatgtatatgcatatatatgtgaatttttataacccattcttgaatgcctacatagaaaaatctctactaagcacagaaaaatgtttatccaagacaaaatgccgtcagactctgtgatcagtattcacaattctcaattaatatgcaacaaatacctgctatgtgactatcaacatgcaagctacgcatggcagaaccaagagtaaagaccacaaaggtctagctcaactagttactcctataaataatggtcaactctgaatggatgaaaaaattcacagataatctttgaagtacatttttaaactattaacaaaaaagttacatctttgtaaatattgacagagcctctagaaagcagtaaaactagcttataacttatgcactcccattgcaaaaataacacctctatgtgtatggttaaaacatcaagcctggatgtttaatgagtgttggcctcatatttctagctacatagtagatattgacatttagatgagctactaccatcttgaaattattgtaataattatctgagctagaccctcttgcaaacagcttttattcctttaagtattcctccttatgttctttttttaaacaaattttgtgctaagttatttcaattacatcccttctttgtccattaacctgcagtattttcctgcaatactcagtaacaaagtctcaaatttgctgcttgacttcaaagactctccataatgtgaccctactttatggtctctgatttcttaataaattctgttccaagaagcccagtctctttacctcttctcatttaaccggatcgtcctgcctctaatcttttgtcaatttcgtcctttccgctcatgtccttgcttctttctcttcatctatccttttaaagcacaactcaagcccaatcttttcagtgaatttcagaacatacttcatcttcacttcctcctacaaaccttgtagtgatcagtgacatcgttccttcagcaaaatctgtgtgtacatctgggatttaggcattcccaagtatgtctgggtagcttgtgggccatttatttgagctgctttgtgtgggggaggaagtttgcacaaagaaacagatgagagaaaagaagatgacagagaagatatggggtcaatctcagatataggccctctctcttgaccacaaggacctatgactgaacctgagggaataatttggaggaaccctccagatggctttgtcacctgatgctgctccacctgagattctctcaccaactcactctgctgcattctttagaacttaatcctgagagaaggctccaagacttgctgagtaggcaaaccctgtatataatctgtcatatcaccatggctgtctcctttctcacacttaacacaactgcaatttggcctctatttctgtacttagaatttgtctcccccactaaacataacagcaaaaaccatacctatgttcattcaccgtcacaatatcaatgcctttcacagtgtctagcatgtaagtgttccataaatacatcctgaatgcataaaatcacaaatgagacagagaaacaagcaccccaatgtcttggtgtccagttgatcagatgggactctgagtggcatgcagagacagttgccacatttcatcatgggacacagtacactcccacatcttggggttttaaatgaaagcccacaccctcaaacccatgtgttcagtactctcatggcaggtaccagcagtagatgcagggatgaggcagcccctactaccttcctaaatggagaacaatgaccaagaagccaaagtaggaggaaaagaacatgaaagatgcctcatggtgactaaggcagacagatgaactcacagaaaacacattgtgagaacacgtagaacaagcaagcagaactgctaaaaaggggagaaggttttgtgagagttgggggcctcagacagtaaaatttttatcactattgaaatatccacaggctgagcaggctcagggaagcctggggagacttcaattacataaacaatagtcagtcccatgtatctcagcactaaatcatcctgaaattactaaagtgcatgtgtcttttctctccaccttacaggtggcaccatgactgctgtgccactgcctcatgtctcctttatatatggcacaattcctaacacagcactggacgcataattaacattcaattcatagtggtttaaatgacctattttaagtattgccttctgggcaatcacttgtaaactcccatcagatatatacccaagtgagtatataatattcaatatgcaaaaagcagaaaaaaatacaaacatttattgaaaacttagaataaccccaacctatgcaaactagtttcattgtcaagtaagaaatctttggttttttatttttgttatttattttaacagattgtacagataggaaactatgattcttcaaggacaagattatatggtaatagatatcagcacaaagttctgaaactagttcttctgaatctaagaccagagaactagacaagtaaatggaatttgtagcctctggaaatagctgtaaattaactgtacccaattagctttgatgttcaaaaaattatactcattacttcataaatgttatttaaatgtcatacaaggtggaccaactgacttctctgatgaagaaggcattgcacacattttacatctgagtcatttctgttcatagaactattgaaacccaggttgggtagctcccttcctttctgtaccacaaatcaaaaacacataaaactacgcataaaaagctcaataatttatgaatatgctaaatgaaaaaggactatgcttttaacttgtaatttaatactatgtttaatcactttgggctttccatgttgacctgttaaccaacaaactactcatttactcccactaatgacttctactcataattgtatttcctacaaattattgttcaagcatttcaatgtcattcatccataattacacagtctcagagcaccattcttactaaatgggcatggagaaaaataaaataatccttgtgggttaacacactaaaatcactaattgtcctctgtttgcttactttgtaggacttaaatctttattctaagaataactgccaaggcctttcaaaatcatttagggtgggggagggagagagggagagagggagaggtgggggggagagagagagagagagagagaaaggagaaagaaaaggataatttattaaaataatgtttgcatcagaataaaggaacttacaaaaaaaactagaaatattgtcctcaaatatatacaaattatttcccccttatttctggatgcaacatcaccattatccatagcaaaacattagatgctgtcttgtatgtggatgaacatttgtcacgcactaggaagacaaacacaaagaacagagtccctttcctccagggcccatgatcagtacaagaaatagacaaaaatcagaagtgcactgtgcaaggtgcagtgacactcaggggtgtacagacatggagcactgcaatcacaccaagggagtggtcctttccaggaatgcttcccagaagaggtgataactgagctgggtcttgaaggacaaaccaaagtgtgccagatgacaaaatgggaagcgtaccctaggcaacgacaatgatgtgtaagatggtgggggacattcgaataactgctacatatgtggcatggccagagtacaggtatacagaaggtataggcacctagtgactgtcccttcattctgaagaggtgagcaggacccatccaaaaatgactcacaggccctcccatagcacttagagtttatcctaaaaattatttggaaaccactaaatgaatatttgggatgaaatctaagaaatgatactgttgtgaaactgttttaagcccatagtacacatatcaaactaagagaagaaaatccttagtgagaaaatggacttactgtatgttggggaaaatgagtcaaatcctaagacaaacaagagccagccagtagggaaactgagagcctgatgtgttactctatgaactagatatcagacctttggagcaaatgaagaggactgggcaaaataatgcaggactttgttgacctgttttaaagaccttaagttgtatttgaaatagttataaaaacaaatatatacatatatatattcattatttatttttatatatttatttttaagttctgggatacatgcgcagaacgtgcaggtttgttacataggtatacacgtgccatggtggtttgctgcacccatcaacccatcatctacattaggtatttctcctaatgctctctttccccttgccccccacccactaacaggccctggtgtgtgatgttgccctccctgtgtccatgtgttgtcattgttcaactcctgcttatgagtgagaacatgtgtttgattttctgtcttgtgttagtttgctgagaatgatggtttccagcttcatccatgtccctgcaaaggacatgaactcatccttttttatggctgcatagtattccacagtatagatgtgccgcattttctttatccagtctatcattgatgggcatttgggttggttccaagtctttgctattgtgaacagtgattcaataaacatacgtgtgcatgtgtctttatggttgaatgatttataatcctttgggtatatacccagtaatgggattgctgggtcaaatggtatttctggttcctgatccttgaggaatcaccacactatcttccagtgtaaaagtgtttctatttctacacatccactccagcatctgttatttcctgactttttaatgatcaccattctcactggtgtgagatggtatattgaccagtaatgatgagcttttattcatatgtttgttgatcgcataaatatcttcctttgagaagtgtctattcatatccttcgcccactttttgatggggttgttttttcttgtaaatttgtctaagttccttgtagactctggaaattagccctttgtcagatggatagattgcaaatattttctcccattctgtaggttgcctgttcactctcatgatagtttcttttgctatacagaagctctttagtttaattagatcccatttgtcaattttggcttctgttgccattgcttttgatgttttagtcatgaagtccttgcccatgcctacgtcctgaatggtattgcctaggtttttttctagggtttttatggttttaggtctaacatttaagactttaatcaaacttgaattaatttttgtataaggtgtaaggaagggatccaatttcagctttctacatatggctagccagttttcccagcaccatttattaaatagggaatcctttccccattgcttgtttctgtcaggtttgtcaaagatcagatggttgtagatgtgtggtattatttctgagggctctgttctgttccattggtctatatctctgttttggtacaagtaccatgctgttttggttactgttgccttgtaatatcgtttgaagtcaggtagcatgatgcctccagctttgttcttttggcttaggattgtcttggaaatgcaggctcttttttggttccacgtgaactttaaagaagttttttccaattctgtgaagaaagtccttggtagcttgatggggatggcattgaatctataacttaccttgggcagtatggccattttcacgatattgattcttcctatccatgagcatggaatgttcttccatttgtttgtgtcctctttgatttccttgagcagtggggtttgtagttctccttgaagaggtccttcacatcccttgtaagttggattcctaggtattttattctctttgaagcaattgtgaatgggagttcactcatgatttggttctttgtctgttattggtgtataagaatgcttgtgattttgcacactgattttgtatcctgagattttgctgaagttgcttatcagcttaaggagattctgggctgagaggattgggttttctaaatatacaatcatgtaatttgcaaacagggacaatttgacttcctcttttcctaattgaataccctttatttctttatcctgcctgatggcccaggccagaacttccaacactatgttgaataggcgtggtgagagagggcatccctgtcttgtgccagttttcaaagggaatgcttctggtttctgcccattcagtatgatattggctgtgggtttgtcatagatagctcttatgagtttgacatacatcccgtcaatacctagtttattcagagtttttagatgaagggctgttgaattttgtcgaaggccttttctgcatctattgagataatcatgtggtttttgtctttggttcggtttatatgctggattacatttattgatttgcgtatattgaaccagccttgcatcccaggtatgaagcccacttgatcttggtggataagctttttgatgtgctgctggatttggtttgccagtattttattgaggatttttgcatcaatgtttatcagggatattggtctaaaattctcttttttggttgtgtctctgccaggctttggtatcagaatgatgctggataaaatgagttagggaggattccctctttttctattgattggaatagtttcagaaggaatggtatcagctgctctttgtacctctggtagaattcggctgtgaatccgtctggtcctggactttttttggttggtaagctattaattattgcctcaatttcagatcctgttattggtctattcagggattcaacttcttcctggtttagtcttgggagggtgtatgtgtccaggaatttatccatttcttctatattttccattttatttgtgtagaggtgtttatagtattctctgatggttgtttatatttctgtgggataggtggtggtatcccctttatcattttttattgtgtctatttgattcttctctcttttcttctctattagtcttgctagtggtctatcaattttgttaatcttttcaaaaaaccagctcctggattcattgattttttgaagggttttttgtgtctctatctccttcagttttcctctgatcttagtgatttcttgccttctgctagcttttgaatgtgtttgctgttgcttctctagttcttttaattgtgatgttagagtatcgattttaggtctttcctgctttctcttgtgggcaattagtgcgataaattataatttagtgctataaagatctgttgttagtctgatgggcttccctttgtgggtaaccagacctttctctctggctgcccttaacattttttccttcatttcaactttggtgaatctgacaattatgtgtcttggggttgctcttctcaaggagtatctttgtggcattctctgtatttcctgaatttgaatgttggcctgccttgctaggttggggaaattctcctggataatatcctgaagagtgttttccaacttggttcccttctccccgtcactttcaggtacaccaatcagacgtagatttggtcttttcacatagtcccatatttcttggaggctttgttcatttcttttaactcttttttctctaaacttctcttctcacttcatatcattcgtttcatcttcaatcactgataccctttcttccacttgattaaatcggctactgaagcttgtgcatgcatcacatagttctcatgccatggttttcagctccatcaggtcatctaaggtcttctctatgctgtttattctagttagccattcatctaatcttttttcaaggtttgtagcttctttgtgagggattcgaacatcctcctttagcttggagaggtttgttattaccgatcttctgaagcctacttctgtcaactcatcaaagtcattctccatccagctttgttctattgctggcaaggagctgcgatcttttggaggagaagaggcactctgatttttagaattttcagcttttctgctctggtttctccccatctttgtggttttatctacctttggtctttgatgatggtgaccaacagatggggttttggtgtggatgtcttttttgttgatgttgatgctgttcctttctgttagttttccttctatcagtcaggaccctcagctgcaggtctattggagtttgctggaggtccactccagaccctgtttgcctgggtatcaccagcagaggctgaagaacagcaaatattgcagaacagcaaatgttgctgcctgatccttcttctggaagcttcatctcagaggggcacccagctgtatgaggtgtcagccagcccctactgggaggtgtctcccatttaggctactcagggtcagggacccacttgagtctgtccattctcagatttcaaactctgtgctgggagaaccactactctcttcaaagctgtcagacagggacatttaagtctgcagaagtttctgctgccttttgttcagctatgccctgccccgagaggtagagtctacagaggcaggcaggcctagctgagctgcggtgggctccactcagttcgagtttcctggccactttgtttacctactcaagcctcagcaatggcggatgcccctccccaagcctcgctgcctccttgcgtttgatctcagacagctgtgctagcagtgagcaaggatccatgggcatgggaccctccgagccaggcacgggatataatctcctggtgtgccattttctaagaccattggaaaagtgcagcactagggtgggagtgtcccgattttccaggtaccatctgtcatggcttcccttggctaggaaagggaattccacaaccccctgcacttccctggtgaggcaatgccccaccctgcttcggctcacactccatgggctgcatccactgtccaacaagtcccattgagatgaacccagtacctcagttggaaatgcagaaatcacccatcttctgcgttgctcatgctgggagctatagactggagttgttcctattcagccatcttggaacccaaccccgttttgccaaatttttaaggtaacgttcatgggttccaaggattaggacatggacatacatgggtgtcattttttagcctatggttgaataaatagtgctgtgaaaattggctattcatttgaaaaaaaatagataactgacaaactatatcagaatcaattctagactgattaaaataagggcctggtaactttttctgtaaaaagaacagggagataataaagagtttggggtttgcagaccacgtggtctctgtcataatgactgaactttgcccttatagtgcaaagcagccatagataatacctacacaaatgggtgtggctgtgcctcaataaaattttgtgtataaaagcaaggaatggaccagatttggtccatggctcatagtttgctgaccctagttaaagacagacacaaatgtgaaaaaaaagaaaaaaaaaaaacaataaaagtaccaaaaaacaagtaggtaaatttttatatagtctttgtacagaaaagagttgataaacataaaatcaaaggcagaaaccataagagaaaatatttgtagatttgccatcacaaagattggaaaactccatagaagtactaaaagataaataacgtgtgaaagaaaccggttctttgtacctctatcaagaattttacaaagagagctataagccagaaagccccaattgggatctcaaaataagctgaaaaagttaaaattgaggagactgtttcagaaagaagtatattctgcctttctgccacaagtaaataccagctatgtgtacacaaaatagaagcgaggccatgtgtgtcttaagtccaatgaagaaaatggaatgagttttagttacatccccttgcaggccccagtttcatcatctctaaaatgaaagtaacgatcccagtctttcaggcttcacagggtggttgtgagagttaaatgagagtaaagaatgggaagcagctttgaaaattataaagtgccaggatctaggtaaaatccaattttgacaaataccaaatataatacccaattcaatgatactctttttccatgaccaggctgaaagcaatactattaatagtattgctttgatgatgcatatggaagaattctctttgaaggaaaaatcacaagcttctgcctatgtagctttccatttacttaacaaagttgagtttcttgtggtactcaaaaatgtaaaaaatgaaaatctacaccacattaaccatttagtaacctaaaagaagactactactgaagcatgagggtggccaagggggagagttgaaaaacaggacagaaggtgttagcaggaagctaaatagcacctaatagccatgctataaatttcggactttaccttagaaacaacggaaagccactgaagagttttgagcagcagcacaatataaacagatttgtgtttttaaaagatcaacttggctccagggcaaagaatgaattggaaagaacagaagtggcaactagaaagtaagtttaaaagcttacacaataatccaggcataagttgaaggtaccataaactaaggtgacagtaatggagatagagagaaggatatgggctcacaagttatctaagaattaaaatcaacaagacttagtgatggacatgataagaggaatgataaaggaggtatcaagaatgacaaccaggtttctagctgagagattattggaaaacggtaaacaccatcccatctttagactaataatgggacaacttcaccaaatcaaaagtgtaaacaaataataacaatgataataactgacatttattgagtacttgctcaacatctgccattgtggtaagtacattacatgttttgtttcatttaaaccacataacaaatatcatgagaaatgtcttaaaataatgtccgttttatagatgtgggaactgaaacactggggagttttttaaggtccactagctagttcacggtagagatgggatttggaccacgcagtccacttcaagagcccaggctcctcatacttactcagaggaagatgagtgagtgagtactctatgacggagcaaagtcaagctcatctagagaagatgcagaacgccagcaaagatcctcacaacctagcaggaaaatggaaactacagaaagtttgaaaggaagagatgaaccttggagctagttactttcctttgagaagctttgtgtcaagatgagaggcttgaaatcctcgtgtgtctaaaatacgatacagagtcagttatgaggtttgctttggtgactgtgatggttaattttgcgcatcaacttgactgggctatggggtacccacaactttagctaaatgtaaattgttcttcgtgtgtgtgtgtgtgtatgtgtgtgtgtgtgtgtgtgtgtgtaggtatttctaacgtaattaacatctgaatcagtagactaagtaaagaagattgccttccttaatgtagatgagccttatccaatcagctgaaggcctgaatagaacaaaaaggctgagtatgaagtaacttgaactgagacattggtcttatctggtcttcaaacttagactgaagcataggttcttcttggatatccagcttgctggccttctgactggaacttacaccattggtcttcctggttcttacgcctttggacttggactctctatctgcttctctttttctctccctccttctctctcccttcctctctctctttttatctctctctctctttttatctctctctctctctcaaatggcttatgactcaaatggggcgaaagttaatcctgaggcttttgctcaagtttttcattcacttattcaagcaaatattttttaaagcatattatgagtccaggcactgttctaggcaatgcagattaaaaaaaaaaaaaaagtaaagtgcttgccctcatgatgtatatattcttctgggagaggtaataaaataaatacaaaaaaatgtgaaaagtaaaccttacataatacattaaataatgttgaaagctaaggagaagaaaaccgaaggagcaatgtcaaacggtgatggggaaatgttgaaatttgctcagaagttaaacagccattgggaaagaggcattccctttcatctggagtcacaggactgccatttctgcctccatgagggcagagtttgactgaaaatgaagccagctgaggggaaagcagaaccaagagtcgcagagaaacaaaatcttaatgacttcattggagcacctggactcagctgtgcctcaagttttttcttttcgcctcaagttttttattttcagttatatgaggcaataagtgctcttattttttgttcgaattgggttttctgtcacttgaaaccaaaaaaagacctgactaatgccgacactttcaagtatatatagaaacttgaagtaccttacaatgtgtttctaagtggggttcctgctgtacttggattattgaatagctagaactcatttctaattagcagtatacatttacatgcaaacacctgaaattaaaagaccttaaaaacagcatgttcacttaaatgtgtttaaacaagtcccctaaagtgtggtttatactattaatttaaggaaccctttcttaaagattgttccaaggttactcttgtccagatcaatgagattttagcagacacatatctgccactgtaaatagaatggttatacagtgtttagacttttttgaagtattgttagacagaacagaaaaaaaaccttattttttgttggtggtgttggttatattttagaggacatagagccaagggtcagtctccatctgctcaaaagagagaaacactcatcagtcactggctgtcctaccacgctagggttccaagtatgccaggaccatgcttgctgatgttaactcaactgtgtaattacgatctgccacaacatgccagctgaccagaaccccaacactgaattaaagctcatttaaatttaagagtagaaaaaggaataaatacttttttaattttcctcatcctcctttctccattcttcccctctatttaatcctccttccttcccagtcctaaataaaaaccaacaaaacaaagccaaataacaaccgcaaaatgacagtggctctccccttcaaccccacatccctctagggcaccctttttacatacatagcaggttgttgggtgggacttctgctcctctagaacctaccaggaggacacatgcataggatcaggagatgataagcaccccacattatagggaagccacagacagggagaaaacatctccttggggcttattaaagaaagctaatctaactctgccacttttgccatccctggagcagagtccactccatcatttatgaatgaccaaaaacaaggagattcaaagaaatcctgagagatggggatgagccatcagcctgggtgagctaaccctggcctttcctccccttcctatagagcgaggtgtgaaactacttctctcttattaagcaaagaaagagggctgcataagtatcaatcacagagtgacctgtaagaaggggagactggcttcttttcccaggtggaatgtctgcatatgcagcctatttgctcagctgctcatgcttatctaagcaggggaaacaattagagaaagagcagagcagagaaaggggtgataagtgaaacatctttcatgtggatttgtaagtttcctctggatagctgaattgtagggaagatagcttggcttgaaccaactttctagtactccaccaagaccaacccccaaggtggatgctaacggattgaaaacccaagtggggcttccacattgagaaactgtgcagtggaaaagcctcctacaagactccagtgatttcatgcaggcatcttaggagggagactcaatagtcagcaattattattcagagagagagcaacacccaacagaggatataggtgcaccgttaagtattaagcttgttaaacctctcaccttacctcttccacctgccccatactgacaatatgaaataagaaggattagaggaagagtgagggagcagaccctaccatcccaagtgcctcaagttgaagctttgtgggtgaggaaggtaacattaaatgaataggagactgagtttttaaactagattaatcaggactggcattttcaatatctgaaatcaactggaaagctattggtaaccaaggtgtttttaaaggacaagaaaaaggatccatcagaatacagacgaaggtagtgactaaagaaaaataaaatctattctgagtcagacttctgtctgaaaggtttgcatctaccaaacatccctaaaattgtgtcggttgcatttgctcaggcctgtggcaaatttacacaccacatcagctcaagtttcccatgaaatcacaggtaatattttgtggtgataaatgcaaggggaaagcagaagtgaaaatgtggcttgagcttggacagtcagagtgcactttccccctgggcaccatgtatagtccttagtctgctaagtaactctagcggactttgggaggcctcccctggttattttttgaaaagaatacagtgttcctttctttggtagtagaaaatcaaagtccacatgaaatcaggaagtcccaataaccatagagaaggcagcaataaggagtaggagagagtgaagtcaatacatgcagagacagccagggtaagggactgaggggtgagtcctgtggacattcggacccttgaagacagtcacgtctaaggccattgtctttctctccatcctgcgttttgattacaagaattcataaatccttggttctaagtttgtttccagtgggcttctgtcccctaaaaccaaacaatttcagagtaataaagctacatataaaaatgccatgtcatagctctggtttgtatctagctcaagggaacgagagacagaagaaaagggaggagtcttggtctagaagaaataggtaaggaaaggggcaagaggagacagcattggagactattaatcaggtgacgagagagtggagatttaaaaatatattgttggataagaggaactgttatgacatgaaaatgggctctagaaagtttcaccctacatcaaagaacagactttatagaaaatgtcccagagctaaatcagtcttggggaaacaggaatcatgcagagaggccctggacacctcaaaaggatccatacaccacagctaaaagaatgacctagtagagttttttaatcacagttttaacagtggaactctttcttctaacaaactgttactttgaacacaaatatataacagataaaagcaataaatcaattacttgagcaatttaaacctttattacttgacctccaatattcattgtttagggaacccctaaatcccctccaggaaacatttggattttgtggagcacaatgtgaaaaccactgaccggaaacacactcccacacatgtgcctgttccacacactttataccatgcttaaagacagcctgatactctagcaactatgaaaatagtgcatattacacagtactcatagcaaccatggaatttacatgcagacacttggcattttcagaaggaaaacaaaccatatctaagcttgcttatttagaccactgcttttatttattcctaccaaattcttatgttccttgcaattgcactcgtgctttcttcaatcatgccccacatactgctttttctcaggaatttccatgtatatttaatgcctatatcttgtaatttcttgaaaaggacaaagacagaagtccagccaaggccatgagactgtttttctcctaagaaactgtcagccaaatttctcagggagaaactggaaatgaagtgagagacattgataaatttccctgctgaacaatcaataaaagctccaccatcctgctcagattcccactgtggaagcaagagccgtaattacgttgtcaaaaatttaagttgcccaggctgacagcaacccacttgaaaagtgacaagtgattggcactcagtttggagtggtgaacctggattggcagacagagtgatgaaagcaaaaggcaagagtgaaatttccttattgactacagctacccaaaccccagactgccactcaggaggaatcctgagaccctttagtcatattaacgcatcaaagtgagcagctgacagaagttactaaacaatctgaactccaccagcaactcagaacctgtcctcatctactctcaaacagaaacagaaaagatggtgctgtgtgtgggtgtatatgtgcagctgtgtgtatatgtgagtgtataagggtgtgggacttttcctacattcaaagaaatacatgtaacgtgctttcaactccatcttgccttgtgacagctgaacaccaaagcctgtttgcttagcgattttaatccaaggtaaaaatcagctggagcagaagggtttcaaagagcaataataaagaatgagatggaaggagaaggtgggaaagtgatcggactgacatgcagaccatttgtgtgattctacatgacctgagctggagttaaattagaatccattcagcattgctgctgaatattaggaaccaaatgtctgccaagggcctcattcgctgggcagtgccctgcttcagactatactgggacccatgcaaatagtttctaagaagccttttgtaaccacgcccaggaatggtggttatccacagctgggaagcagctgcaccaagagagattaaaatctaaaggtgttgactgggtggtgggaagagaagagaagatgcctgggaatgttgttaccacatgatctccaaggttaaaacccttctgttactctgatgaaaagagatagacaagaaaattaatatgtgttttgtgtgcccaacactctggaacacttcatgagcaataagtttatgaagtgggaactgtgtttttctgattttttagagatctgttgaaggtcatagctgatctgtggcagaactgggcccatttctgattccaatttgattaaccacttgaaccagtgtttctctgagtatagtcaataggccacctgagtcacatcacatgtacatttccaggcccagaaatctagatttacaaaaacctctcccaaaaggctcttctgtgcgccaaagttggtgaatctcctcattatgttatcctgggaaactgagtgaatgctgggtcattagggacttcctgggtgcaaaacagtgaatcaagttgctcactattttgcatacttgatggtgaaagaaaattagctttttcctaaagccccagtgtcaccagacccacctctggccccggcaaaaggccagtgaaattatgaaatgactttagccatgatataccaccacgctggaggggaaatctgtctgagacctcaggtggtgagggagaagtgacaggagagaattgatgagctgcacgtggggctgcgattctctgacagatacatcaggaaaggaatccctgtcacccaaatggctgagctcttttctacataatatttgtttcaaatgcatgagatgctgcagcatcacatcagagaggaaatggcttgatctttgcctgtgttcaatgggcaagctctgtgattcaggtgagatcctagtcaattctctgtcctaaatgctttggggaatgtttaaccagttttgaaaatggcctaatctgggaatataggaaaagggggagagagagagaggagggagaaggagaataaaggagagggagggaggagaggaagggaggaaaaaggggagagagagagaggagggagaaggagaataaagaagaaagagggagaagaggaagggaggaagcatggagagagaggagggagaaggagaataaaggagagggagagaggagaaagaggaaggaggagatggaaatgaggaaagcagagggagaggaggtctcattctcaatatccagtaacatcagatggctgaagtagcaacattttttctgaactttcagaattttcaaaccatattagaggcatatactttgcttgaattgccccatattgactgtaagcaatgggactagggattttcttgacatttgcttaaccacaaaggcttacatgcacaacgtacatttaaaatacaggcacaaaaggtatatttatgagttctttctttgattcttcacaatagagcatgataattagatgagcttggaatgaaagaggcagaagaaaataattaggagagttttcatttttcctcatttgaattcctattttcaggaagagctgtgctatctgcatcatacaggacagtggctctcaaatctgaggattcctcctaagcctggggtcctctggacgatctatgggctggctgaaccacaaatatacaccaacttattccccagatgcacttttttactggtaaaaagcaacatattgggttagtggcttaagaggccattgagctagagcaaacatttgaaaaccatggctgacgtgggaatagatcctgggctacaaaatcaatgtagttgcttgctgatgaagataggaggtaaaaaggtccccttggaagttgatcatagaatcaacatagcaagcattttgaatttctatccagtgagttatggggtatttttaacctcacaaaatttgatccccagtgtctagcacactgggtagcccacagtcaacacttaaatgcttgaggaaaagatcttgcttcctttcatagtaagccaaaagagacacaagcatgttttttgatagacaatgattggggcctgtggtcggtatgagacagagtctggataaagaaaaatggcagattcctcagcacagctccatgccctcatctagagcaattatcctatgacaagtggattattttgtgatgccaatatagaaatatcattgtgtaactgacattatgatttctggagattgagtcactatctggagcccacattttttatctgcctttggctcatgctatgcaaccaaaagcatataaacacccactgaaatatgcttactcattattttatactgatattttacagttgatactaaggattatcctggcacacctggtaatttcctgactctcaagagggaaaaaaaatgtccattttgcaaagtggaattagatgatcagaaagcaaataaagttggagtagaacacactgtagcctaatctattttctcctgggaatccttaaacaccccacctatctgtaagaggattctaagtagaactgtaattaaaccctgctcatggggtagagggtttggggagacaggaagaggttcaacaactaaatgaggttgtctgtatttgatttgggataccaggctactgcatgttgagagacatcagtacatgctaagtaattgtatcagtcagttttcactaggctatgctgcaattacaaatgcaaatttcagtggcttatgacaaaggcttatttctcactcacatacatgagagcagtaggtcagctgcagcactgccccatgtcgtcttcgttcaggttctaagcagaaggaactgcctctatctgggacaggctattctcaagtggcaggaagaaaacgaaatggctaaagcatcgtaacaggtcttaaaaccttcacttggccatgcagtcccccagttctgctcacattccactgaccaaagcgagtataaggctaagtctgctcttgcaaaggggccgggaagtatggtccacccacaaggaggcactgaaagtcacctaacagtgggtggaagtatacacaatcctcttacagaaagaggagcaaacaattgggaacggtagtgtactctgccacatgaatcgtaacagttttacttgttatttaaggaaatagtgccatgctctaactgacctggttggctcagcaactatagtcaaggacttttaaacagttttatcagtttccactgctagacacagctctacttcatttcctctgatcaattgcctcactcaccgtgcagagaaagagttccattcctcacagccaggaacttgactccatagggaaagaagggagttgagtaggaactcccgtagagtgtgatctgagctctgccttggaagggcttgtcttcggatccaatccggagctctccaccatcagaaacaaggatggcgtgtgccctgagctcgatgggtcctggggccatgaaaatcagcttgccccctaatggacaaagggaaaattgtcagtccctgggaggataaggcttaccgttttgtcagtttcaatgcctgatgaaatccccttcatttaaatacttctgctggaatgtagacttattttatcatgctctctcttgtagaagcacagtagggtagaccagacattcaggagtggaagcactattatttagccagtttaggttagctattactattctctgctgctttattacattttcatgacaataatctaaatgtccagcaatttaggaatggttaaataatgtatgagaagaccactaactttaccatttaacaatagataaaattaagaaaaaaaaaaactgggacatatacaagaaatagggctagaagaagatgtgccaaaattgtaagaattatagtaaaaggaaatgtaactagggctaacactgtggcatttgtagcattttagctgaccagcatccattatactttcttttgttaacagaccctaatttccttgaggtattgctctgccccattgactagagctgagtggaactgtcaagcaagacatcttatcctaccatggccagagtcacatactcgggctttaagagaaatatggagcaaaagggaaaagaggtaggaaatatttagatctcagttccagtggtggcattctaaggagcctgggaagaacacctgcttctgagatgcccacctgcccatctccctgcctgccccaccacccgccacttgcatcaaatgctttgattcctacgtatttctgtccctgatttttcagactgctttccactgattagtaggttacccaataccttcccaatacattccatttttaaaagaaaagttgggttctcttattggcaaccagataaccttaactgatacatataccattttgctctgatgtccaaattttcagtaacacaagaatattcgtttataatagaattattttgcattgtgagattaaataatttaaaaattaaaaagatattttcatttttataatatctttctttaaaaggctttagaatgtttatattttacgtagaattttctcaataatgtcaaaataattaaagcatcccatatgaataaacactttaacttcaataagctatttagtccatctttctcctgcaagtggtttacaaaaataccagactagacccttccatcctgtaacaaagtagtcagaattgtatctttatatcagacacaccagaggtcctcttttctaaatccaacaatagtttcccatctcactcagaatagaagtcaaagtccttacattgggctacaaaaggtccctcatgatttgctacccaacctccaatacctctctaatatcattttctaaagctcacctgttcacacatatgctacaaacatattggcctgcctgttagttctcaaacaggcctcagggcataagctcttccctctggaaggttcttttgatattcccgtgaatatcatgaataagaattatcaaaaatatcggaaatatctaaaatgttattggaattatcggaatgttctgatattcccatggctcactctcccttgttactattcaaatgttaacttctcaccaaggccttccctctccagtctatataaaatagcacaccctagccccttgcctaaatgcctttttctttgtaatacttgatatcaggcatattatatatttacaggtttattttctgccctctccccaccagaatacatgcttcctgaggggaattatctgttttgttcacttctaaattattggtgtctagaaaagtggctggtaggtagttggcactcaacacacaattaatggttgagtgaatgaatgaatggacatatctttttggagattctgatttaagtgcctctatttccttatatacaaacacacacacactctcccattttctcagaaaggatgttgttcttacacttaatttataagcctacatagtgtctcaatgagcaaaggggggcaaaggatatagagatagcaaagtatcagaaatgcctcaaaaggcagattctactataataagaagagtcttggtgagatgtagtggagggcaaagactcttcatctgctaatgtagtcataaatccagagtgccaagttattgagttgagtttttgttgctttccagaaatcacagctggaagtagttaaacatgcactggagaaatgagagggagagaggaaaaaggcaaaaatgactttagtcattatcatgtaaaccaaaaataaaattttaagtcccccaaaccaactgaattgacccctcctcttaggcaagggcgttacaaagttaaactgtaaaactagttcaggccatgacggggagtgtcagagatgcctcattataccctcctccctttggaattcagaaataagtaaccagcattaacattaaaacagagacattaagactgacaaaatagactctgtagcaataagacaccaaattccaacctgactctagtacagcaccacatgacagatagccggccctgaaagaaactgaagtattttaccccaaaatatattaaacggccctgcaaagctgtctcttgtggggaaaatctacattctgtagaaaattcccttccttttctggatctttaccctgagctaggagagtgctaactaagagtctggaacctttttagatctgctaagaaacatttacagtctattctctctgaagcctgctacctggaggcttcatctgcataataagaaccttggactccacaaccacttatcttaacccagacactcccttctgttgattccaggtctttagataagttaataagttaactctttcaaccaattgccagtcagaaaatctttgaatccatctatgacctggaagcccccactcctacttgtctaacctttccagaccaaaccaatgtacatcttatatgtattgattgatgtcttacctctccctaaaacatataaaaccaagctgtagcctgaccatcttgggcacatgtacttacgacctcttaagactgtgccccaggccatggtcactgaaatttggctcagaattaatctcttcaagtattttacagagtttgactcttttcatttaattgtttacctccgtcttagtgcagagacagtgatcaataaatgtttgactcaatagtcaaatatggaggccacttcttccctaacttctcttcagctttcctcagctcctttcctcaagactcttttcttcaattctaaagcccaagccatatgccatcagtaatagtcacgggatgtatacttggaccagaccccttcaaggaccttttctttcagtcacaatttagaatgacacaccccgcataggtatccagtttctccatctgtaaaatgggcatggtaagaatttcaccctcagaagattaaggtgagatttattgaaatagttcttatagatccctggtctggagtctgacacctattcaacccttaatgcaatggtctctgtggctatcatcacactcaccatcttcgcttcctccattattgctgtgaaaccatccttgcaaagattctgacagtgagaaaaatctaacatggcttactccatcttgttcctagcctcacaggctggctggctttgctcattcctaggtgtaagccaagctaactatgggaggaatttagtttatagtctaaccttaaacaaggatgataatagcccttcccaaaattaaactacctttgtaaaactaatgaaaggccacaaggctaggattataagaggtgccaaaattctaagatgtttagcatatttaaatgattactagccattgttcaagaggtcacaagatttgcaactcttccaaatactccaatagataacatcactattttagaaactgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaaatggctggtccttgcctaactgatgacattacctggtgaaattccttctcctggctcatcctggctcaaaaagctcccccactgagcacgctgtgaccccccactcctgcccgccagagaacaacccccctttttcctttacctccccaaatcttataagatggccccactactatctcccttcactgactctcttttcggactcagcccacctgcacccaggtgaaataaacagccttgttgctcatacaaaacctgtttggtggtctcttcacacagacgcaagtgaaattttgctgccatgactcagatcagggaacctcccttgggagatcaatcccctgtcctcctgctctttgttccgtgagaaagatccacctatgacttctggtcctcagaccaaggaacatctcaccaattttaaatccggtaagcagcctctttttactctcttctccaacctctctcactatccctcaacctctttctcctttcaatcttggtgccacacttcaatctctctcttctcttaatttcagttcctttccttttctggtgatgcagaagatgcgttttatccatggacccaaaactctggcgccagtcacggactcaggaagacagtcttcccttggtgtttaatcatgcggggatgtctgcctgattattcacccacatttcagaggtgtctgaccacgtggggatgcctgccttggtccttcacccttagcagcaagtactgcttttctggggggcaaggacccccctgaccccttctctccatgtctctaccccttctccacttttctggggggcaagaacccccccaaccccttctccttcacccttagtggcaagtaccgcttttctggggggcaagaacgcccagaccccttctctccgtgtctctaccccttctccgcttttctagggggcaagaacccgctgaccccttctctccgtgtctctactctctcttttctcttggctcgcctccttcactatgggcagccttccaccctccattcctccttctcccttatcctgtgttctcaagaacttaaaacctcttcaactcacacctgacctaaacctaaatgccttattttcttctgcaatgccacttgaccccattacaaacttgacagtggttccaaatagccagaaaacagcattttcgatttttccatcctacaagatctagataattcttatcgtaaaatagacaaaccgtctgagatgcctgacgtccagacattcttttacacattgtttcctccctagtctctgttcccaatgcgactcatcccaaatcctccttctttccctccctcctgttctctcagtcccaaccccaagcatcactgagtctttctaatcttccttttctacagacccatctgacttctcccctcctccccaggctgctccttgccaggcccagccaggtcccaattcttcctcagcctctgctcccccaccctataatccttttatcacctccctcatcacaccaggtctggcttacagtttaattcctcgactatccctcccccacctgcccagcaatttcctcttaaaaaggtggctggagctaaaggcatagtcaaggttaatgctcctttttctttatctgacctctcccaaaatcagttagcatttaggctctttttcatcaaatatgaaaaacccagcccagttcatggttcgttcagcagcaaccctgagatgctttacagccctagaccctaaaaggtcaaaaggccgtcttattctcaatatacattttattacccaatccgctcctgacattaaataaaactacaaaaattaaattccggccctcaaaccccacaacaggacttaattaaccttgccttcaaggtgtactataatagagtagaggcagccaagtagcaatgtatttctgagttgcaattccttgcctccactgtgagacaaaccccagccatatctccagcacacaagaactccaaatgcctgaaccgcagctgtcaggggttcctccagaacctcctcccccaggagcttactacaagtgctggaaatctggccactgggccaaggaatgcccacagcccgggattcctcctaagccatgccccatctgtgtgggaccccactgaaaatcggactgttcaactcacctggaagccacttccagagcccctggaactctggcccaaggctctctgactgactccttcccagatcttcttggataagcagctgaagactgatactgcccgattgcctcggaagcctacaggaccatcgcagacgctctgggtaactctcacagtggaaggtaagtccgtccccttcttagtcaatacggaggctacccactccacattaccttcttttcaaggacctgtttcccttgcctccataactgttgtgggtattgacggccaggcttctaaacctcttaaaactccccaactctggtgccatcttagacaacattcttttatgcactcctttttagttatccccacctgcccagttcccttattaggccgagacattttaattgaattatctgcttccctcactgttcctagattacagccacacctcactgctgccctttaccccagttcaaagcctccttcgcatcctcctcttgtatccccccccaccttaacccacaaatataagacacctctactccctccttggcgactgatcatgcaccctttaccatcccattaaaacctaatcacccttaccccactcaatgccaatatcccatcccacagcacgctttaaaaggattaaagcctgttatcactcacctgttacagcatggccttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccagcccagcatggccttttaaagcctataaactctctttacaattccaccattttacctgtcctaaaaccagacaaggcttacaggttagttcaggatctgtgccttatcaaccaaattgttttgcctatccaccccgtggtgccaaacccatatactctcctatcctcaatacctccctccacaacccattattctgttctggatctcaaacatgctttctttactattcctttgcacccttcatcccagcctctcttcgctttcacttggactgaccctgacacccatcaggctcagcaaattacctgggctgtactgccgcaagccttcacagacagcccccattacttcagtcaagcccaaatttcttcctcatctgttacctatcatggcgtaattctcataaaacgtgttttccctgccgatcgtgtcctactgatctctcaaaccccaccaccttctacaaaacaactcctttccttcctaggcatggttggatactttcgactttagacacctagttttgccatcctaacaaagccattatataagctcacaaaaggaaacctagctgaccccatagatcctaaatcctttccccactcctctttccattccttgaagacagctttagagactgccccaaccttagctctccctgactcatcccaacccttttcattacccacagctgaagtgcagggctgtgcagtcagaattcttacccaagaactgggactgtgccctgtagcctttttatccaaacaacttgaccttacagttttgcctagccctcaagtctgcgtgcagcagccgctgccgccctaatacttttagaggcccttaaaaccataaactatgcttaactcactctctatagttctcataacttccaaaacctattttcttcctcacacctgacacatatactttctgctccctggctccttcagctgtactcactttttgttgagtctcccgcaattaccactgttcctggcccggacttcaatccggcctcccacattattcctgataccacacctgacccccatgacttatctctctgatccacctgacattcacccccatttctccatatttccttctttcctgttcctcaccctgatcacacttggtttattgatggcagttccaccaagcctaattaccacacaccagcaaaggcaggctatgctatagtacaagccactagcccgcctcttagaacctctcatttactttccatcgtggaaatccatcctcaaggaaataacttctcagtgttccatctgctattctactactcctcagggattattcaggccccctcccctccctacacatcaagctcggggatttgcccctgcccaggactggcaaattggctttactcaacatgccccaagtcaggaaactaaaatacctcttggtctaggtagacactttcactggataggtagaggcctttcccacagggtctaagaaggccaccacggtcatttcttcccttctgtcagacataattcctcagtttgggcttcccacctctatacagtcttataatggactggcctttattagtcaaatcacccaagcagtttctcaggctcttcgtattcagtgaactaatagtcttttaaaaacacacctcaccaagctcagccaccaacttaaaaaggactggacaatacttttaccacttgcccttctcagaattcaggcctgaactcggaatgctacaaggtacagcccatttgagctcctgtataagacgctcctttttattaggccccagtctcattccagacaccagaccaacttggactgcatcccttccaccaaaaaaaaaaaaaactcatcatccctactatcttctgtctagtcatactcctattcaccgttctcaactactcataaatgccctgctcttgtttacactgccggtttacactgtttctccaagccatcacagctgatatctcctggtgctatccccaaaccaccattcttaactccctcttaaagtaaataaataatctttgctggcagggctatgctgaacctccttaagcactctctagttagatgtcctggatcctcccaattcttaatcctttaatacctgcttttctccttgtcttattccattcttttttcaattcatacaaaaccatatccaggccatcaccaatcattctatatgacaaatatttcttctaacaaccccacaatatcaccccttaccacaaaaccttccttcagcttaatctctcccactgtaggtttccatgccgcccctaatcccgctcgaagcagccctgagaaacatcgcccattatctctccataccacccccaaaaattttcaccatcccaacacttcaatactgttatgttttatttttcttattaatataagaagacaggaatgtcaggcctctgagcccaagctaagccatcatatcccctgtgacctgcacgtatacatccagatggcctgaagtaactgaagaatcacaaaagaagtgatatttaaatggcctgttcctgccttaactgatgacattccaccacaaaagaagtgaaatggccagtccttgcctaactgatgacattaccttgtgaaattccttctcctggctcatcctggctcaaaaagctcccccactgagcactttgtgacccccactcctacacgccagagaacaacccccctttttcctttacctccccaaatcttataaaacggccccgccccatctcccttcactgactctcttttcggactcagcccacctgcacccaggtgaaataaacagccttgttgctcacacaaagcctgtttggtggtctcttcgcatggatgcgagtgaaaaacactaagattggtcttttgagatttttttttaggcttttgtatttctgaccaccagctgacttcactcagattcatgacccaagactcaaccagtgctgtggcccttacctaaagacagactcagtacacaaggactgttttccatacccctatgatttcatccccaacaaatcaatattccccataccctagttccctgcccaacaaactacccttgaaaacccctaacctctgagcctccagggagattgatttgggtaataaccccatcccccaaatggtgtggagggccttgcatcagttaaatgctttctttactgcaacgccatggtcttgacgaattgattttgtctgtgcaactggcaggaagaacccaccgggtgattatatctacaacctgctcaatttctacaagtgccctaccacttgagcactgctagaccatctgcatccaacatctctctgttactggtccttttgaaatattttgtcatatataatatttcatactctagggtaaagcagcaaggtcagtctacaggctccatgccagagcagtaccacactgcttaccagacttccaaaggattccctaacaattttgacttttttcctttcattgtcattacatagaaatgcagtaataatcatgagtcccagtgtgagcaagaaggaagaaatatgacctgggctacagatcaaattttatgttaactaaaatttttccctcacagccacatgtcattaacatcctaaataattatattcaactggtagaacatggatttgtatgacaggactgccgcattgtaaatagtcaggaaatctaaactgaccttgatgagcaagtggtaaaggcagggaacaaaatcaaggttcctgtcctgagtctgctattgacctctgaatgagcctcagtaagtcccatacaattgctgggcctcagattactcaggtcccaaatctctcctactcagtgcctattaatggtctgtggtttcatccgcaaagtggaaggtggaattatgagttcctttcaactctagaacacttgacgtctacatctttatgaatgcagtcagatgtgcatgggacactaatggaggcacaaggctcatgttttcctgacactgcctgtgctgcagtaatcactgaattttttcttaagcaagatatgagatgcatagtcaggaattcatataagactacagggaaaacaagaaagctaacatttattcagcacctaccatgtaccaaaatctgtagatatattgtctaaaatgaccttcaaaaccagtctgtgagatcaagatcacattctttatttcacagagcagaatgtggctaagaggcattcatacctattccagcccagaatacacagaaccaaactagaacccaggactacccaaccaaaaggctcagatcctatccatttgcacaaaccttccccagtagctctcaattcactagggttgttctcatagttacatttaaggaaaaacatgtgtgaacctaagaaagtttgcctatggcttgtttatacatgatttattttaattttgttaatgaagatataccttgtctttttccaaaaaggatttgaaacagattacaaggattagtgggtaaatatataaacatgggctttgtcccttttaccatgaagcaaaatgttaaatacactgaaacaaattggtagaaattttgaaacatcatttactgacaggaactaataatgatgctaatgaagggagaaaaactcatcccaaagaaaatgaattatctgcgttgtcaggagtgtcataaacaggactaattaattaatatgaacatcattaactcctgctaaaaagcatccccaccccgctttattagtggcaaatataagaaaatctaggtacatttagaagaaagtttgatgaggaattcagctatttttgcctgaaataattagataaacaaatgaaaccttctttatgtgaaagaagataaagtttatacttaatctatctttatgccaaggcaccaagattttcatcctcacactttattagtttaaaataaatatacagtgggctgctttaaaggatagttacttgagtatgggagggctgtgggaggactttattccatactttatagagcttgaccccatttctaaatgctgaaataaagagcagggctgaaatcagcctttggctgtgacccttaaattgcttgttatgactttcatgaaagctgactatgtcccacaagtaaccttgggtaattttataaaaatcaatcaaccatcattattgttacttccctctaaaataaataaatgaacacaactttttatatgtaatcacctctttccattaaacatctcttttgtttcttttaaagggaagtaaaagagacttttagcagctagctaatgtttgcaaagtacatcaaaatctgcttttggctaacccaacaattagtcatcctctataataaccacaaaataatttgttgttttttttaagaaaacaaatacacaattctattttcccccttacagaaaaaatttaagtataaatattataccatacaatactagtcttcaaaagagtggctatacctactatcttcaactctttttcatgactgtcttttgaaccctccctggtcaggcctttacctgatgaacctgcaaaactgctcctctcaaggccacagatggcaaccacattggtgaatctcaggctcaatgctcagtcctcacccttcccgagtgaccagcagcatttgacaacttggtcacttctttcctaaaactccctctcctcacttgcccagcctctttgtttttctttctttcattttctcatctctatttaaaaaatccaatgtttctatacttctatcaaattttcatcatgtgctatattctatacattgtattgaatcgctaaagaaaacctcataaaatgcaaaagtgctagtaactcataaaagaacagaagaataaactcttctatttagaacctttgtctttccttcacctggtatctaatttcatgtcttcatttttagcaaatactaagaaagctccctattgactcaatgacagtgagcacatgggacttttctaattaagtaggttgggtacaaacccagctggttttcctcttacttcttaggcatcctcttctcagcctcttctgcctgattcctcctgatcatcccaaccactgacacttggtgggtcccaagcctcagccctctaaacacgtttcttatcagtctctgtagaccatgccagttgtcccatcttgtcttaaggttttaaacaccatcgcacgctaattgtcaatgactctcaaatttatatctccaagcttgtgccctcagctcaagattcacatacccaactgcctactcaacatctctacttggatgtctcatagtttcttaactatgagtatccatgaactcctttccttgtcttgccccacagatcttccctcagtccttcccattccatgaatggtaacttcatccttgcaattgctaagtctgaaaatcacagagttaactttcactgtctctcactccataatcaatacttcaggaaattgtatgcattccaccttcaaaacgtcccctataacccaaccacttaccacctccacatctacttctggggtccaagtcactctcatctcacccatggattattgtaacagcatcttaacttagctccctgtttctgcccttatcctctacctcagggttaattctcaaaacaacactcagtgttgtcattccttcttttcatgtgaaccatatcgtgttacctctctgccaaaattcttcaatggctcccatcatatttagagtcaaagcctatcaaaccttacagcgttggttctctctggccccatctgcctctgctctcccccttgttccaatactcctttttgctcccttgcctcacaacatttgctatcgctgtgtgccaatatccccaactaccacctccaatgtgtattccctattcacctctcctgctgcatttttctccatggtactaagcaaatttaacaaaaactataattttcttattttgtttattgactgttttccttctagaagtaaacaccatgagagcaagattttggcctgttttgttcacagccatagtccctgtgcctggaacatggggaacgtgttaagtgatcactcaatacttgttgaataacgaggagttgaaattatcaaagtaaatgaggtctcccagggaggacatgtagagtaagaacagaagaaaggtaaggtgggtaaaggtagggaaacaactgtcaaccatcaacatttaaaggctagaataagaaacaagattcttgagagcagatcaaagaattaggtgagttagaaggatcataaggttgtagacataggctcaacgaagagccttaagaactgttaaagaggtagatgagtgtgtcaaacccttaatgccatttttaggaagatcaagagagaaaaggtgcacagccagcatgtacagagttaggatgtgaatgtcaggtgataaaataaacccagggagagtgattctatttttaaacagaggaaaaatgagaggtaaatggaggcaagaccagggagggatctgagaaccccaattcattagattaatctgtatcaccaagctagataattcatttactcaaagcttgaactatctaaatttttagatgtaaactaatttacttgcctacattgattaacccccaattcaccattttttcttaaaaaatttagcagcctatatattcttacctttcaattattaaatagtcaaatggatagtcgaggaagcctgtggaattccctttccctggagaaaaggaatcatccattcaagatggacaaatcctgctctgcctgggtaaggagagctggctgagtgatctgggcagagttggagtatatccctgtaccttactgcactgtgctgctctgggagcaggagccaggagaaggtgaggaagaggaggaaagaggagcatttagagaaggcacccacagcccaaagaaacctgcattgtgacacggatggacacagcttcctttgttggcaagatccggattagacttgtgcctgatccactggagcagagcctgggaagccttcgaggtgggcttgtccccagccagagaggcggaaaatcaatttggctggcaaacgagagcccccaagagcttagtccacgctccataatcctatccactagcagctcaggaaatagatgcctgagccctcacatattcatgggggatgtgaggcataaatcaggctttaaggattgggggcaaagggaatggactctctggctggctactaattaatcaagcacagaatacctaaacctagcaacctgggatggagccacacacacacagaagcagaggctgctgctgctgctgtttttcccatttttcaaaatttcaattaaaatagatatcagaagaaattttcccctttagctgatactgcttatgcatctccctgttcttcctttaattaaaaaacatgcttattgcaatacttgccagaatcactttaacggtattttaattgtaatgtctctgcctgattaaaaaaagaaaatatgaactagaaagtgtttgcaaaaatgttcacaggatgcaggacaagaatcagacacctccccagaatggatgccacatactaattccttaattagcctggtactgcagtcaaatgggcaatatagagaaaaaaaaaaatatatatatatatatatatgaaataaaatcactgactcagagctgcaaacaatagcagttgggagaaaccattttcatcaactcagatttccctggcggggtagggacctgtgcatccaactaaaaatgctgtgctcaagataagcccattcaatgtggccagccaagtttccactgttctttgctaaaggtctcatagcctttgggaaatgagtagttgggccaggctaattggcttctggtcctcacaattccatagggctccttttattgttttaggctagtagttctcaaacttgaacctgcatcagaatcacttggatgtcttaaaacacagactactgggcctcattcccagagtaggtttactgtagagctcccaaatttacagtttgtataagttaccaggtgatgccagtgctgctgactgggggctacactttgagaatcactactatcagtaaattaagtgattgttctaggtgtccgtaggctggtgatgtttggcatcatctgaaacaggctgagaaaatacaagcctggaattatagaataattcccttagtcactcaaccaacatttaccactagtttccagctcctctgctaggtaccgaaataaaaatgtaaaatagagtctccagtttctgaaggtcacggtgaagttgaattgctcctccgggtgaatggaaatgtgttggttttagtgaattgtcccactttagagatgactataagagaatataaagactgtgactcagctctttactttttctacaaaatatgaaactcattaaggtaaccttataactgtattaactctgtactaattacagagtgtaaacatatctgtggaaggcaaactacacagaaatatttaaaggaactcaaacactaagatataagtaaatgcctttgttattatagctactgttatcaattactacctaactaaactttgatttcctttctacatctagaaaaccatgacttattttatcaacaaagcttctagcatttaagtgctcaaggccttcagctgttccatggctttctaaaaagtcacttaaaatctcaagaagaaagctatttctaaggagaaatagaaaagacaaaaaaaaaatcgtctttttcccgaggtctgtaccaagcatgtaaaaatccccctagctactaagttcattcagataatcttcctctttctctttatcaaagttcagttagcactgacccaatctcatttttgaccagcctgcaatttgatacacctctctaagcaacttgttttttcaaaaggttccaaatataattattctctgaatattataaaaatgatttggtatagcataatagtattggaaataaaagcaaacaatacttttcttatagtatttattaattttaaaaatgagaatacagtacttcctacctttacctgaccccaggaatattgtatagaaactataataatgaaatgctcagtccccaacatatttttatctacacaagaatcccaaatacaaaagtacttcagatttctagctccacttccagtccaggatgaataggatatagggatcattaatgaacaaatgagatggagaggtaaagacagaccaagtcctgcatgaccctataagccatattaagtttggacttgaacttacaggctaatggaaagccaatgaaaggttttaagtaaggaagcttgaaacatttatctttcattactgaaaatattatagcttctctgctaggaagggactggtccctttcagtagcatttttcatgttacaatatccaagttgtcaagacataaaactgtaaattgtttaatatctatctatctgtctgtctgcccatctattgaaagcatgtcctttctcatagcaatggcttatctttcatttaaggctaatcaagtgtgtctgggactgttctctggaggtaaataatgtaagtcattgtctgattggaaaaataaggggtctcagagccaagtgtcccccacattaaaaagcctttgtctctgatctcctgatacacaaatagtaaataaaattggtcactgtctggactaatccactaacatttgagggtaccaggaaggactctgattatagagaaattctcaacaaacatgaatctgcctcttcaggtctgaaactcatttattagcttattcattcagccattatttgagtacctgtttcgtgcctggagataaaatggtgctggcaacacaaaggtgagcaaaaacagagctggcccctcctttcttcagcttacagcctagacctttataagcctccaaaatggtagagggaagaaaaaatacaccttgatattctatttgtaaataattaatataaaaataattcaagtttttaaccaattaaaaattctacctgtgatacacttagctttgaatatcagcaaagttcccctcccatgaaataagtaacacctacttgtcaccaagaaaagcccagcacatgaagacacccaagagttaagagtgaacttcaaaaaaactcgggctagttctgatgctaacttcttcatcaggcctcccttctggataatggcacagaccagccccttagggtaccatgcctgccaaatataggaagaaaatttactcattcctatactgctcttcctccacagagttgcacacacacaaacaacattaacatccagtagaggtttatacaagacattttctccctacacagggaagggaatcaccattatttccattttgtgcattgatttgaggaccagagccttacccaaaaccataaaagagtctgtgactgactcaaatttgaagtcaggctccagtttgctgaccaaactgcaatgaatcaaccttgttgtattgtctgcacataagcatcctatcttctggcttgaagggtagctacgttttgactacaaaagagggcaattcagtccatcttcttttacagccaacttgcagataaattattttgaatttaccaatttgcaacaatgtttccagcccacaaaaccctctcctgttgaccaagatattctacagttagagaaaaaaaacaaattattgttgaatatcatatttttatcaaaattactgccttccttcagattttgttttatcctaactggtagctatgaagtcttgaaactataggcagagggtaaaatgccaagtgactcacacaggcctgatgcacaaagagatcacaagcaacatctcaggaaagttctgtgttgtaacatttctagataactgcattggaaagcattatctgaagcatgcatctactgaatctgaggctggcttagtgctaactagaagcaaccaagtatacaatccctgggattaaaaaaaaaaaaggctgtgataggttcatcatttaatacctcactctgaaatcctcaaatgcttgtcaaggatgaaggaattctacaatgaacctgacagtgagtcagaagaagatgcttcatttcaataaaccaagaatatgcatttccatgacatagaaaccccagatgtaatggacttaaaaagatctgaatgtcctcaaaactgtgaactaaaaaacagttgagagaaaatgagatcatgttccaagctacaccagaaaaacatgtttctgtgaagtcaaagtaacaaggagaatgccggcaagcaaatggatccacttctccatccgtccctccctcgcaatagaaggaaaaacacttcaatatgcattctgaagataacagaagcaaaagcaatccaaggtctttattacccagctaattctttcagtaatccagtttgctttgtatatagaagcagccactatctgtaaataaaattgtaacttaagcctgatattcagccatatctcctgttatctctgacagtccaaaagtaacaaaaactagcattaattgagttcttactctggaccaggctgtgtgctaatggctttacaaatatcccctcatttaatactgaaaacatccatacgagacaggcaatacattgtgatattgccatgcaacaatgataaatgctagctctcattgttactattattgtcattataaccaggtatcaccttaatgaggaaaaacctgagacttacagaaggtctgcaacttgcccaaggtcacagagctgggaagtagtggagcccagattcaggctcagttctttgtggctagaaatactgccaagcatttaactgctttagtataagccagtagaccaaaaaatagaaaatcacattaaaggaaaccagtgcactattaagcagcaacagagactggaaacaagtttctgctcagacacaagcactggcattgtgagtagtaagaaactacaaactgtcttccttttttattgtatatatttaaggcaaacaacaggatgttttcatgtgtgtatgtgtgtggataaatatgtattatatataatgcagtaattactatagtcaaacaaattagcatatcaatcacttcacagttaccttcttttgtgttgtgtgtgtgtgataggagtacctacacctaacagctcaacaccaaggagagagttcattctcccctaattgaccctttcattaatcattatcgttacactacttcacatcaagctgcttgatgaccagatcagaaagagattcattgcttcattcaggaaatatgaatgtttccccaactacagaccacaacccaagatccttgcccgggatgcagaatgctctgacaagagggtaacgttccttctttgtgattatggctcatcataattacttggaataaaaataataaattttaattcagcaatgcctatggccattgggcatcttaacataaaagaatgaaaatataattaactaaatcaaggcaatatgcctatttccatcccagctcattagtattaattgattgggttaattctcttttgtgtttaacggtgcccctaaaaaatattttttttttaaaaaagggagggagggcaggaaggagggaagaagtagagatagtaagtagacaaaagttctggatctttttctaattaaaataaaataataaatgcagctgaagctcttatcacagtcacaaaagaatctgctactttttaagttgggagtcagtacatatagcatcataaataatgacacaaaacattggggccacttctcaattgccccccaaaaatttatgaccctgccttctactatataagtaatatgtgtaagaaaaaaatgtcaattctattttatagatgaaaatatgagtaaggcacagagagttcaagactcttgagggtccataaagtgttggttttcctgttgtacgagcccagttttctacatatcaggatgctggcttccatgaatggaaaaataatataaaggatgtaataccttcataaagtatttccaaatgtagttcttaggtgatctagtttcactgttacttagcagtaatcctttcaaaatatatatacttcatgtagaatgtattctttgtaatatagaaatggctgagaaagtacttccattataatacttcatattttgtcggttaaaatcttttgaagaaattatttttggcttgaaatttctcaggctttatctaagcctgcagatggtatcagaaaaagtaaagaaaatttcactcagctatttttctgacactgtgaatgtatatgaaaaagatagtaactaatatttggagggtgagttactgttgttgttgttgatgatgattgtgattattcaatcttatatttgaagagctctttattatctttcaagtactttcacacatattatagaccaagggaagacattaaaagaggtttacagctatgttacattgatcagatatttgaaagttgtagttcttcaccagtgaagactttggtcatatgccttttagaaacagaaatataacttaccaacagattttatattcctaacaattcatcataatatgcaaatatatatagacatatgtgtgtatgtacatattttgcgtgtgtaaatatgtatatgtgaatatgtaagtgtatatgtgtgtacttatacatacgtgtgtgtgtgtgtgtgtgtgtgtgtaatcagtgagaacaactaaggacagtgaaagtaaattagctgggaaaagtggtatttaagagagcaagggtttaaaatatacacttcttaaatttcacccaggaccatttacttgtccattctttctacaatcaacataaaatttttgagccttcgtcatgcatcaggcactgttctagaccctgaagagacaacagtaaataaattgatgaaatcctttgtcttttttgagcttattctagtagaggagacagactataaacaagcaagtaaattgataatataccatgtgatgataagtactatgaagaaaagtaaagcaacatcaaaggataaagagtcctggggggtggctgtaattttagaaatgatggccagcaagtcctcccagattagttgatattttctcaaagagcaaatgaaataggtgagccagccacatgaatgtggaagaagagcattccaggccatagacattacaggcaaaggtcctgaggcaggtatattcatagaagagctagagcagagtgaatgagaaagacaaggtcaacaaggggatcagaggttaaataatagtaaggaccagtgatttgattcccagtgagttgagattccactggaggttttgaggagagatttgacttaaatttttaaaggaaatggaccataaactgctgggggtttactttaccatatagcataaaagccaaatatccattacttaaacccatgaagccttattttcctgtcacaaaaagttatttcagaggtgggtggttgaatgccttatcatggcaactccagagtcatcagggtcctgggtttgtcctattcttccgcttttccattctaactaacaagtagcatcatggtccaaaatagtggccgaaaatgttgctattacatttatataccagcaagtaggaaagagaaagaaggaagggaaaatagggtgtagttcctactgggtcatctctacttttggaaatttctcagatgttctgcagggtacttcttctatctcatggtaagcccttagccacatggctatgtctagctacaaaagtgttcaggaaacagagcatttcagctgagtactttgttgccaccaatgaaattagggttttactactaatgaaaacaaggaatctgaaatatgggaacaaaataagaggcaatttaagatggtctaggccaaaaatgtggtggttaagactaggttagtaccaatgaagtgttgctacatgggacacatgttgaagatccagccgacggggttcactgatggggtggtcataggaggtgaaagaaagaagtcatggatgcctccatggtttttggtctgagccactggatgtatacaattccagtaagtgagatggagaatttcctcaaactttgatttgtgtatatgttaatatctatgtgatcgcaatatgtctcagacacaaatgatctgcccttcacctcctctccgctctccaactctaatcttacacaactgacaccaagattaccccagtatacattcggcctcactgccagcatcacttattttagaaccagaagttttagtcttttacatttactttctaattatttttctttggtaatattacatgttactgccagtattattcttcattttttcttgtatttcacacaggaatcctaggccactcaataagcattcacaaattatctgttgaacaaaatttgatctgtgtccttgccctgttctcattctttctagaagttatgacctatatctctatgataaaaacctcagcgtttcactctaggtagctctgtcttttgccaacaactcctgtatcttattcgtgcagaaactggaatctactacttagccttacatcctacctactcctcctccccaagagaaagaagagacccttcagatgacttactctccctctccacaggatgagggtttgcctttccaaacctaactcacttatctaaataatatgagagtgaaatattacctaaaccagaaatgctaagaaaaaccactattggaggttggggcaagtattgggattgctcagatatttaaatccttaagagtgagaagtcaaatgaatgttatacttatcctgcctttctcctacacttttctctccttctgatgcctcttctctgttttcagcctctggtgctgtcaacactattcatgatttacctggaagtaacagtacatccagagatttagtaatccaagactttcagctgggaaacttctcccaaatggtagtagcaatataaggccaagacctttgaatgcctgaaggggagcccatactcctgcagaatttgattcatatggagaaagccctggttaaaggcctgccaagagtatcttttctctgaaatgaggctttaggtctgtaattttcctttgtcattgctggtccttaggtagttgatgactgtctatagtggcattcccatagccactagctacacacacacacacacacacacacaaacacacacacacaaagacagggcaagagcccaagctgacagaccattttatcccctaaagggcactaattaactgatttgactgaaaacttctccttgctatagaagagaaaaaaaacagcttccagaatagagaatgacaaaatgcctaaatcctgattcggtctaaaagagacaggtattaaaattccattagtttatcctctttaaaatattttatttttcccctcatgtagctatattcttatcttaataaggatgaatgtttgtgtgttaaatatatttatagtaaagaacagtgttttagtgcagagtttcatagagatccataactaatcatatctcccatgtaattttcatttgccaatgaacagaggcattttgataactattccttatttccagccactaaagtaggccatgatttttattctcatttagcagataaggaaagaaatgcacaaagaggtgaaataactgacttagccatttgaagatgtggtagtagggttgaaattcgaaatctcagcctcttccaacttcataaaccctagagctatatagccggttttgcaataagaaagcctatttatatgactttccatgggaccaagaagtcaaaaccacaacagggtaaaagcaggaagacatggctttcttggcagggtatttcaaaggcagcaacgttaaccaatttcagggcattttgctatattgtgggggctgtcctggataagcatgactaaaaagtgcttgaataaagaagcatattctttgagaacactgttaaccttcttgtttttgaaaaattaaactaatcaagctctgtgcttataatgagtccaaagaaaggcctttcactttgaaccctctgaccacttcttcctttacatagtaaaatttcagtttggtctgaggataaattgtcaactaagttctggaacttatccagaaagtttccctcctccatcccccctacaagtgatataatcatatagaataatattaccaacctacaaacttcacacacctttaatgtgcagtaagttgaggatgcttgtgttagtgtccagcagaagcaattggccattctccactgtgacgttgtcgccatcttgtggcagcctttcaggaaaccagctgtgagtcctggaccatctccggcagaactgtaaagaaaagttgccctggaaaacagagagctgggttggtgggttggttggttggttggctggtctgttgcttcgttggttggttcgctggtttgttggtttgttggttcattcattgtttttgggcgggatagtataagtattgaatcaaaatagaaacttctcaaagaaagtaaaattaatttaaatattttaaatgtctccataaaattggttacctctctctttttcatacaactaacctaaacaggaaaaaacatgagaggcaaaattatatttgaagttcttctgtgcccagcccctggaattctccaataacatgctggtaatgttttcttgccttttttttcccctctagcacaggccccattctacctaacagatgagtttgattccatttatttttacagatatgtattgaatcttggacaaaaagtcataaatagcctggaatagggagaattaaaatgttctgcttgatgggtggcattttgctttatgtaattggtatcatttttcactggctctactgccaagagtccctgttttataggaacattcctcttcctaagtgctcagatctatcctcccactcggccttttttgatattattgttgcctttccccctgtgcctggtgcatcagggctgaacaaagcccatgcaggcataggcagaatgccgactgacttcagatgacaagtaaatagtctggaacatttgagtgaggggtagggagctgtactgacagaagaagccagaaaaggaagcactccctctccaccccagccttcagtccctctctcagaacttttggctttcctgttaatttgtggtcactctgatgtcatacgttttttaaaacagggacataaaaatcacagaaagcaatattgagctcatgcaagaggctggtaacatgtctaaatgccttgtgaagttgtagaagtataattacgataaacataataaaatcacaatagagaaggtgattccttcaaggtaatagatatgacatgtataagccactctctccagtcttcttcccattcagattccaacaaatgtgaagcccaagttcctataaaaataaaccacctagaaggtcctctcatgatgtgttagaggcagatgggagaagatcattagaagggaaggcatgtttgtaataccgacaactacacctacacagagaatagtgctctatagtatttctgagatagaaaatggaaaattgtgttgccagaagagccgttacgttttccagaaaaagatacaaaccccaaggtcaacagtgctaagttgcagacccaacacaatcactgagaaggctttgcaatttattcgttttctacatctgcaaagaagtaaaagtctatgactcatcacaatttaagagatggaaggaaataaggcatagtgataaccagttccagtatcacagaaaaaagaataggtgatccaggagcatcgttgtgaactgcagtatctgtaggctacaaaagtaggagagaattttaactctagatgatttcactataggactagctttaggttggtaaaataataaacagtacttcttataaggctatatatattatacattcttataaccctttaatttactcctgtagaatacagaaagaggaaagggaggcaaatcaaaggaaactggaatgaaagaaggtgggaaaaacagagatggtaaagtaaactgcagaacagggtgaaccaggttatctgtagtgtcagctgcgagtccatgataaaaggacatttgaaaactcttggatttccagaagcccagagatggaaaggactctagcaaaatcctatcccataattttacagatgctattttaggcagtgttccttagagcttaataaaatgtagatttctctagtgtcatcatatacctgtgaaatcaaaagctcaagaattgggacccagagacctacaattttaatgatcctctcagatgacacttctgcatcaaaatttaaggatcaattcagagcaagggctggaggagaaggagatatatctttaaaaggaaccaagatgttttctccaaaccaacatccaaagcttagggtctttggccaggatcgcccaaagactagcaagctaggaagaatgatgtgttgatgaactgtaagaaatatgaagacttcagcagcataacgctttctgagacattaacctggtggtcagatccataacccagccacagaactatgaagaaaaccagggctcattacacacacagtaaaatgatcgggaacaactagacattagttagatatttaagtgggtcaaaggtagactatttcatggtgttatccattaattaatttgagaacatttttaaatttttatgattagcacagatatctgttatctagctctcaataagctttagagactttcttgctctgaagcacttgcttatgccatttgctgccttccatgtgctataacctcttggcctagcctgtcagccttcaaagattgctatacttggtcccaacccagtaggtggaaaggtcaaatactgttatctctactttccagtggagaaagcaaaggctcaaagtgtttaaatgatgtgtcaaagttcatagtgatggaggcaaactggagtcacaaaaaggaagctcccatctgaagtttttcccttaccatggcctctcccgggatgctctttcccaaaagatctgcatggctcactcccttacttaattcatgcctctgctcaggtatcacctccttacctgtattattatttttaaaaagcacccccaatcattccttcattccttctcccctaataatgcctcattctagtattaaataatacaattccttgcatatttggttatcacttactaagcttactcaaatgaagcagagacttggtttgggtcattgctatattcccacctccctaaaagatgtctagcacatagtagttgctcaataaatgtttttgaataatttattaaatgaatcttatacctgctggtgccatacatgcttttacagatatcacacacaaacacacacacatctcttcctaatgcaataggtgaagatacaggtgctaagaccttaaaaatgctatatcccctaggtcttctgaaacatttacatcccttttcgtgttttcaagctccatttaaacataaaccaaatgatgaatagtgctacttaattggaacctgagactcagattcgatctcataaaatcttccaccaattttttctttcaccttaagtttctctagtcaatgtggccaatttcaaatgaatacagatgtttaagcattcagtttcaagagacctaagtttccttgtgccctgaattccccttagcataacaaagatatcttgagatgtataaatgtttattgatgtactcatgcttttacacaaaataattactaaatactaaaaaatctaaaaattactgcagcatccactgcttaccagctacctggggaaatagaagagcagcatatctctatgattgcaagttatcagtgtaatccatgattacatgcacgttgccataagaattttagctctcctacattttcagttaacagagctggtgctatcattccctcccagggaaatgctccatgaaacagtgaggatggctcaccttccaacatcttcatcctccaatccatgtcactttgatccaatcaagaaaaaaaaaatgccaacagcattgattaaagattttgtgaatatatttgagaatgtctctgttgataccaacatatttttggtgaaggccatgttccgtgtcaacagcccagcttacttccacctaatataagctctttcctctatagttcccatgatgctcagcctttagctttagtgttcttcctggagataaacacatcactcattcttattctgcagatgaagaaaatcaattcctcataggcatatgggggcagccgtgaaaatagagatacaagaattgcccagaacgtgacctcatctttgcatctagccccaaataaaccccaaaaaaagcagaaaaaaactttcctgcctcagctaggaagcttatgcaatttgttttcttcttacagcatgtcagcacttctctgaacttcagggaatgtgcagtgtctgcaaatcttacatgtcaccttaaatgtacttgcaacaccaccagagttatcttgaaagaagtcattgatcagcaagttggaacacccggcaaagcaaagacctatttgtgagtgtatgcattgagctggggtggcagaggaggtggcgtatgggaatctctgtaatcacagtgtctcctggctgacaagaacaagaaataactgttctgacacctcaccaaaatgtcttcttcctcagcatccaaatcctggaaataggaaaagacaagtccctgtaaccattttctccactccgtatccttctttattttctccaaagcactcatctctacctaatacaatgtatactggtttataatcagtcaacccctaatagaatgtaagcttcacaagagtgtcttgcttttctgctgtatccctagaacctacaataatgcctggcatctattggctaccccaaaaatatgtttgaatgaataaatggtcaactcttatttggacttatgatgccataatgaaaaatctttaataactgaaataatatgatatgaagctataatttaattttgttcagttcttctttacattgaaatgttttaatttttacgaaaccaactttatttaccttttttgtgacattcttcattatgttatagatgaaacatcctctttcaccctgacataaataacacttatatgtccttcttgattggtgggttttatatctgcatgttactcctcaactaacttacaatttatgttgatggaaagttttatacttttttcttgtttttattccttgctatttttcccccaaatagctaactgattgtcttcataccattcattaaataacatttattctcccaattaatactcttggctattttaacagttgaattataatgttcaatgacattaaaccttttggccaattaaaatcccaaatccttttgtatgagctaatataaaggcgtttctcccaaataaatgtgacctcatccttgttcttaaggtacttatattatcatttagaaaaatacaaatagccagataattaaagtgtgattgattcaataattaaaggcataaccaagatgctatgggagttcagaggattagatggctgaccacagtggagatggccttgcaggggaaatcaagtgcattaaacatcgttttctctttttaatctggacacaacagatgacacaggctgagattatttcagctgattataaaacaaaagatagtgtagaaaagtcaactatctacaaatccaggattatgaatagagcccctaacctataatctaataactctttagggaccaaaaaggaaattgaattagtttggtataatttattcttactgacctcatgcaggctctaagtgatcactttcttttctcggtggttataaacccctcatgattacaagataacatgagaatgtccttccacactgcactgtgtagcacattgactactcaaagaaatgtcaacagtactttttgtcagagattcctgcccagttcaaattgaccctttctcatcattagaaaaccaggcaattcattgtcttatctcttggttccacacacttcctatcctctgcgatttctcaaaggttgctgactctacctcagtgcttcatatatctaagttattagccctcttaagcttcagaggattttcaaagtctgcagacaggacaaatttacagtcttcttttatcgtttcctctatttgaatcttcaaatctcctctaatagtatctcttctgaattttaagtccaaagaccttttcacttgtgggagaaaaaatgataatgatagctactgattacttaatatttctaatgtcccaagcacaatgctatacattttacttacagtatcactaatccttatgtaaaccctgaatatctgagacaggtctcagttaatttagaaagtttattttgccaaggttgaggatgcatgcccatgacacagcctcagcaggtcctgatgacatgtgcccaaggtggttgggacacagcttggttttatacattttagggagacatgagacatcaatcaatatatgtaagatgtaccttggttccatccaggacaacttgaagcagggagggggacttccaggtcacaggtagatgagagacaaatgattacattcttttaagtttctgattagcttttacaaaggaggcaatcagatctgcatctatctctgtgagcaaagggataattttgactagaacggaaggcaggtttgccctaagcagttcccagcttgacttttccctttagcttagtgatttgggaggccccaagatttattttcctttcatactcacaactaaaaaatgtaggtattactctttccacttaaagtttaattaataataatggccaacacttacggggtgcacttaacaggtattatctcattttgttacagactcttttcagactactttccaggaactacagagtagatggatccctgccttcaacaaatgtttattgagcacccactacacaccaggcacaaaacaaattcctgacctcatggagcttatattttagggagataacaggttaaatatataaaactaatagtgtgctctgaagtaaaaaagaaacagggtgaagtggatcagaagtgccagggtaggaagagctatttgatatggagtgatcagagactgctctgattggattggattggattggattggattggattggattggattgggaaaggagcagagaagtagagtatgagccagaggctatcaaaggaggaccttgaaaaaagggtgtgcttggagtactgcagctgcagcctgaaggatcaggcggctggccctggaggaaggaacgctgtatagccagatggcctttctagtgatgcaatgagaaacactgcacaaagacctgggtagacatcaagttcttcatatgtcatagaaaaaaaaaatcaaggaaaacactcagtaacatataacgaggtcagcaaactacagtccacaacccactattttgatattggcacacggcatgacaattcatttacatattgtttgtggctgctttcagtttgtgacagaagcaacatggcccacaaagcctgaaatatttactatctggctctttataggaaaagtttggggaccccggtaaattctgtttcatactatactatcagtatagtacctataatatgctcagtatagtgtatctatagtacatcagtattaaaacatgcgcaaaatggaactttctgtaattgaaaataggtaattataatacagctacctgagacttgagggactgcaaacaaaaacatcttagtgaaggatatacattaaagtactggaaactgattcaattcttcccattttttagtacacaataagccagatctcagaaagccacagaaaggcaagtggaagtgtgggaagttgtgtgtgtgtgtgtatgtgtgtgtgtgtgtgtgtgtgtatgccactcacgcactcacgtgcatgcacatgaatacacacacacacacacacagagccagatcagaagattgacagatacatgctagcctttttcacaagctaacacactgccatttaaccagcgagcatggagcacgtgtttgtgttcccagtcactattaagagacaaggttaacattttaagtgatggactacaacatgttatttccccatgcaatggacccatgacggcactgccttcgaaaacacttaatttcggtgattgaatacacaggagcgtactttccctgctatgaacgtttgacagctccgcagtttcatacaccaggaaaccttttttttcctcctttgcttttttcctgtctttacacctgaagggaagcaaaatggatatgtggtggcagaggaaaaaggaagaagcccagagaatgaaaaccagcttatgagcttcagtgtattttaaaataaaagtattcactgccatctgctctaattacttctaatgtttgggctaccatcttcatacaatagaaataatgatctcctcaagggcaaaaaaaaatttttttacagaaacaaacaaaagttgattacatttagctcccaggctaaagaagcatcaagctactttgtagtgaacaatcaattaggagaatgggtaggcctccgattaacactaacaaattaggtccttttggtggttccctcccttttcttcttttcctgcctctttagaggagctgtgctcacagctcactgagggcaaagagctgactaggcatatttctggatctagggttattccacacaaattccttacattttgatcagaaccagataaggccaagtcttctccctgtcttcttgttgacatcagacatgtcccagctttaatactgaatatagggctgggtattctaccaagacttcggattacttcatggagtgaactgcttaggggccaccccagacttgaactcctctaaggaagctaaagcccacttagcctcagtaaagtctccaggaacagacatgatccaggccaggtccattccttagacttaagtgaaacacatggagcccagaaaaacatggaacagacttctacaatgccagcaggagaaacgttgctttcacaaaggctgagtctagtgaccttctcaaatcctcaaattcaaacatattacttgtatgaagcagaattctgagatgtcctaggattctgaacccctggtgtacacaccctgtgtagtcctctccccttcagcagaagtagagcctgtgaatatgatgggctatcactcccatgattaggttatgttatatggtaatgatgatagaattatgcagatataattaaagtgagagatcagctgactttgagttattcaaaagggagatggcctctacctaatcaggtgagtccttaagagagagattctcccactggccttgaaggagcaacctgccatgtggcttggaggagaccatgtggctagaacccaagaacagcctttaattgctgaaagtggtcacagccaacagccagcaagaaaatgaagacctaaatcctatattcacaatgaattgactttcactgacaacctgaatgaacttggaggtagaccttgaattccagatgagaatgtagccatgctgacactttgatttcagccttgagagaccttgagcagagaacccatctactctgtgcccagactttttaaaaaatttttttaatagatttagagggtacaagtgcagttttgttacatggatagattgcatagtggtaaagtccgggcttttagtgtaaccaacatctgaagagtgaacattgtgcccattaagtaatttcttgtcccaccttctttccaccctcccacccttctaagcctccagtgtctattattccactatatccatgtgtacacattatttagctcccacttataagtgagaacatatggaatttgactttctgagttacttcacttaagataatggttccatacaggttactgcaaaagccatgatttcactcttttttattgctgagtagaattccaatgtatgtgtgtatatatatgtgtacacacacacacacacatatatatataaatacatacacaccatattttctttatccaatcatttgtcattggaaacttaggttgattccatatctttgctattgtgaacagggttgagataatcacctgaatgaaggtatctttttgatataataatttcttttcctttgggtagatacccagtagtgggattgctagatcaaatggtacttctatttttagttctttgagaaatcaccatactgttttccataatggttctactaatttacattcccaccaacagtgtataaatgctcccctttctcagcatcctcaccaatatctgctgtagtttgactttttaataagagccattctgactaatataactcggtatcccactgtggttttaattttcatttctctgatgattactaatgttgagcattttttcacatgcttatctgccatttctgtgtcttcctctaaaaatgtctgtttgtgtcctttgcctactttttaatagggttgttctggtgttttgtttgtttgtttttattgagttgtttgagctccttgcagatactggatattagtcctttgttgtatctgtagtttgcaaatattttctactgttctgcaggttatctgttcattatgttgattacttattttgctgtgcagaaggtttttagttttactaggtcccacttgcttatttttggttttgttgcatttgtttttgaggtcttggtcataaatactttgcctaggccaatatccaaaaaagtttttcctaggttttcttctaggacttttatactgtcgggtgttacatttaagtcttcaatccatcttgagttaatttttgtataaggttaaagatagaggtccagtttcatgtgcctgcatatggcagtccaatttcccccgcacacttatcgagtagggtgacttttccccactgtatgtttttgttggctttgtcaaagattagttggttgtagacatgtgactttatttctgggttgtccattatattctattgatctatgtgtctattttaataccagtaccatgctgttttggtgaccatagccttgcagtataattcgaagtcaggtattatgatacctccagctttgttctttttgcttaggattgctttggctagttgggcagttttttggtcccatatgaattttaggatggttcttctaactctgcaaaaaatgatgttgacattttgatagtaattccatagaatctgtagattgctttcaatccgtgagcatgagatgttttttccatttgtttgtgtcatccacaatttctttcatcaatgttttgtagttttccttgcagagatctttcacctccttggttaaatatattcgtaagtattttatttggttttgcatgtgcccagacttctgatctacgggaccatagataataaatcggcattgttttaggccactaagatggtggtcatttgttatgcagcaacagaaaattaatatgccactataaggaccttcttgagagaacagttttcacagagaccatgtttagatttttccctctttattaaagttactgctcaaaagcataaataacagcaagaaaggtgggatgccagtgccaggcagaaggacaggttattcgctcactgcataaactctcctcacacaggacatgcaacatggaatttttcaatttatgatgccaaaaaatgtaaagtaagacctgatgcagacctttcttttgctcaggaagaattatgactaccaaagatatacagtaaataccacaaggacttctatgtagtcaccaatacttactatctaggctgaagaaatgaaaactttctgatcctgaacatggccaggatatgtgtgcttagggggataacgaagttttttgtttgttttttgggttggttttttttgctttttgttttgttttgttttgttttgttttgttttgttttttgagacagggttttactctgcacccaggctggaatgaagtggtgcagtctcaaatcactgcagactcgacctcctgggatcaagcaatcctcccaccccagcctcctgagtagctgggactacaggcatgcaccaccacacccagctaatttttgtatatttctgtagagacaaggttttgccatgtttccctggctggtcccaagctcctgagctcaagcaatccgtccagctcggcctcccaaagtgctgggattacaggtgtgagccaaccacacccaggccaacatgaagaatttttaaaggcccgtattctgactctatgtctgagaatgatatttgactatgattggtattaaaaattctactcttccactagcattgcttcctgagaaaagaggattttcttttttttatttctcattttaaaaaaagaaagataaggcaacaagtttcagggaaaaaccaagctcaggaacaagaaaaactcattctgtacctatatcttcactagccttgactaaataactttttcctagttctttaagcttcacgtttgaggtactttttagagagaaaaagaaattcatttgtttatcctcaaagcagcatcatgtgttcttaagctttctgcatgtattgcctggtatttgataatgtgcaaggttatttgtgttaatgctaataccacaaaattatcaattgtacctgaagaatgaggaaacccaggaagatgtttcagaggtggggatgaaatctcaataacctagaatttgagaaacttgcctatgcaatctgatgcagatgctttccttgtacgtgcagattttgtagaataaaaccatcaccctcatctttgtgaacatttactgggtgctcactctgagccaggaactgtgggacctagccttgtctgcatgaaggcataattgaatttctaagctcttagagcccagtttcaaatgcattgttccctttagcccaaacacatccgccacacattgtcccttttctgccaaaccctgtttattggttccaaatgcaatgaatcatttactgacttgagcaacattagaggtaaacaccaaggttaaaacgtagagataattgaataacacaccaactaccagtaacagcagtccaggcaaaagaggaaatagatccagagatttcagaaagggcaatctgataggaaccctccatgtcaggatcaaaaccgcatgccactttgacatgacagaaaaaacatctgcattttatttttttcaaaattgtatgtgccagttattaatatgggaagaagcagaaagcaagcaggtggtaacataacttaaataccccagtgattaaaaataaaccatccaaaaatcaactatcatgtatttagtataccaaaacagtggtgtaaagctgggttttttaaaaaatatatgtgtctgatttattgctttcactgttgatgaagaagattaataaaatatatgcatttcttttgcagtacacttttctctggagaaaactccagaaagcaaacattgtccaaagcccttccaaaaaatcataaagctcaatataacttccatatagcaaaatgcactttaatcatttactttacagtcacctggaattcattgtatgcaattcacataatgtctaaacttgggcatataacatatacacatacgtttataccaaatttcctttttacgtgtcctcaaaggcagaaaactcagaatctttggtgaatactaagcaatccacaggcacagttttttcccaggaagtccctcatagtttggaaatccaaaatccccaaagaccctcatgaaacaagacttcaagtgcaatagttaactaccttgggattcaaggctgaatttactcaataaaccatactaaaggtttatcaaagaccacaacacctctcagaaacatgtgcaaaatacattttccagaattctcccaactttggggaattacacccttgccaaaaatgaattgttcaacttgctgaggattaattatttatgtggctctgttttgctttaagaaaatagagatttcttttttccccgttttcccaactagaagaaatatagctcccaagaagcctctgtgttatagttcagggataatgaaagcttagctattggttccaatatctcattttataaatgtgaaactcagtgactgatacaagattacccaatgaattgaataggggtaggtcaggacaaacaccaaatcaaagtgatttttggtcttttaaaattttcttgatagagcaatcactattcatcccagtacgggtgaatcacatcacagaccccatgaaaaagggggcaagcaagaagcacagttttctattattctaccatttcccactcattgatgaccttctgatagccccctctccagaagaagtttcccttacctgggatgtacctaaagtagtgtttgtttgtttgtttgcttgttttagaaaattgagaaagaaagaaaaaaaaacattttttaatcaatcaccatgaaccagaaagaattaacttaccttcttactcccttcttatactcagcctctctcaagtctttaagcttctcatctgggcaaaccaaagcaaacttaaaccatgcttagtttaaataattattttaaaccttttgaacagtttgagaatatttaatgacaatgtaataggcatagactgttgaaagcttgtcctgttccctaagcaaccaggatgataagaagacacccaaagtatgtttagaggataggaggtcaatgtagaaaataaatgaagcttaacctggatggagttggagaccattattctaagtgaagtaactcaggaatgaaaaaccaaacattgtatgttctcactcatatgtaggagctaagctgtgaggactcaaaggcataagaacgacacaatggactttgaggacttggggaaaagggtgggagggagtgagggataaaagactatacacattgggtacagtgcacactgtttgagtgatgggtgcaccaaaatctcagaaatcaccactaaataatttattcatgtaaccaaacaccacctgtttcccaaaaatctattgaaataaaaaataaaaataatagaaagaaaaggagattaggacacagatacagaagaaagaccatgtgaagacacaaagagaggcagtcatcagcaagccaaggagagaggttcagaagaaatcaaccttactaacaccttgatgttagatttctagcctccagaatagtgagaaaataaatttctattatttaaacaacagaaaactaaataaataaaatttaaaaataaaacataaaaaataaaattaatgaagcttcattacattttgcatattaagcaagaaaattgaattttaaagatagaacttaggctaatttataattcacataaaagacgtttctttgtttttacttaggagaaatattaatgatattgtatttgacaatgatttcttggatatgacaccaaaagcagtacaaaaaataaataaataaattggacttcatcaaaattaaactcttttgtgtatcaaaggaaatcatcaatagagggaaaaagcaacccagggaattggagaaaatatttgcaaattatacaactgataagagattaatatccagaatatacaaagaacttccatagctcaacaacaaccataacaacaaaacctgatttttaaagtgggcaaaggacttgaatggacatttttccaaagaagatatacggatggccaataagcacatgaagatgttcaacatcactaattatgaggaaatgtacctcaaaaccacaagataatactttacatccattaggacagctatcagccataaaaaaaaaaaaaaacaaaaagaaaaagaaagtgaagtgcagtgttgcctatagtcccagctactcaggaggctggggcaggaggattgcttgaatctaggagttctgagctgtagtactgcactatgcactaagcatgtctgcactaagttcagcatctatatgggacctctccagagcaggagaccactccattgccaaaggagggatgaatcgacccaggttggaaaaagagcaggtcacaactcctgtgctgattacgagagtagctggagcctgcccatgaatagccacagcactccagccgggataacatagcgagaccctttctctaattaaaaaaaaaaaaaaaaaaaaaaaaaaacagaaaacaactgttgccaagactgttgagaaattagaaattagaactcttgtgtattgctggtagaaatgtaaaatggtgcaatcacaggggaaaacagtaggacaattcctcaaaaaattacatagattataattcagcaattctgagtatatgctcaaaagaattgaaagcagggtctcaaagagacatgtgcacagctatgttcgtagcagcattatttacaatagccaaaaggtggaagcaactcatgtgcattgacagaggagtggacacacaaaatgtgatatatacattcaatgaaattttattcagccttaaaaagaaaggaaattctgacaaatgacacagcatggataaatcttaaggacaatattatgctaaaagaaataaaccaaacacaaaagaacagatattgtataattccacttgtataaagtgcctattagtcaaatacacaggaacagaaattagagtggtagttgccaggtgctgggggaaggaggactagggagtcattgtttaacagattccagtttgggaagacgaaaacatccttgagacggatgctcgtgacggttacgcaacaatctagatgtactaaatgtacacttaaaattagttaaaatggtaaattttatgttgcgcatattttaccacaattttgaaaactgaaaggccaggcacggtggctcacgcctgtaatcctagtactttgggaagccaaggtgggtggatcacaaggccaagggatcgagaccatcctggacaacatggtgaaaccccgtttctactaaaaatacaaaaattagctgagtgtggtggcacatgcctgtagtcccagctactcgggagactgaggcaggggaatcacttgaacccgggaggcggaggttgcagtgagccgagattgcaccactgcactccagcctgggtgatagagtgagactccataaaaaaaaaaaaaaaaaaaacctgaaaaaagatgtttctccatatttgataaaatcaatattcttgggttctgtaattctatagatcaaaccctcagattaaaaaattaaacttacttagtttgttcagtgcttctctgtaaagcctatttggaattggggaattttagaacatctaacatcctcatttttcagatgagaacactgaagcccagagaggtaaagtgtctttctcaaggtcctaaacccaggtgaaagaatgagaaaacagaaaagaaggcaaccctcagtatatatgcttccctcattgctctgtgaagggtgggtttgcacaccttgtttctgtgtgtgtgcatgtgtgtattcacaagccctgtttacctgtccacgctactcccctactcccaacctgaaaacttacagaaatcacctgtagtcttcagatacactctgctatttcatgtcccatgccttcatttacagagcttgcctccattagcttcatcgagaacagcctttcacccctgttctaccagacaaactcattctttcaaagccaggtcattcctctttcttccagaagcttttgatattgtcccctcaccccaaagcagagctaccctcacccttcttactgcttccaccaggctttgcacatactgctgtagtccttaccccacactgccttacgaagtttagtatattgtagtattttctatttccactctctaagccagctccactacctaagccagatgagtggagctgcaagagaacctatgggagagcttaatggaaaaggcactagtatttgattcccacctggaaagtctaaagacaagagactggctggagctgcccttgcccagtggcagagggaagagggggcactggtttgggggcaagctacatgtcacctctggagagacaggcaaatgtagatcccaccaaagggaacaagctgatatgacttaaagagatctttcccaagaggcagactggattggtgagggagaagcaaagctcctcaccaccatcctccccgcaaaaaaatgggccagccattcagagagagttgcagacctaagatcccagcaggaggatctataatgaagccacagaaaatcccataagagagagctgcacctgccacacatgatgtctcctttggccctactcatctctcctctcaggccaactcctagaggaaggaaggaaggagatggagagaagagagaaacagccattccccaccccaccccacaccaaggtttccaagccatctaggggtgaaggagccttttaaaattagataaatttgggggtttcaaaattatattggactgaattggagttaagagattattagagcccatcaagattaatgtgttcaaaacacatcataagataaggacttcaaagtagtctttgaagactacctcagccaggggcatttcagtgttcaagggctgtcaaagccaaggaacttgcaggggatggactagaggtgaggaacaggaaacacccaatgtcactaggctttcaacaaacatgggctgtgagggaagaagaaactcagttacatgctaaaaggggccataaagtcaacagaggattaggggaagtttggggttctttatttaagattaaacagtttatgaactgagagaaatgcagaaaagagatgaggccgttttgacatcaggtgctaccaagcaggagaggaggtaatctagaatacaagtagggatcagcccccttctctgctcatctcacaaacactgtaagtcccaggcatacgtcctcttcttcctcatctgcacattcttcctggatcctgtcacctcctgtggcttctattatcacctacctcataacaattttcaaatctgtatctcaaactctgaaccgaaaggtttgaactgaaggagaaagtgtctcaactctctcctaaactctaaatggatggatatctccatttgtatgttaactggagcactcagccataacatgtgtataatgacattcattattttcccctttctacaaacttatttacttagccattaatatcaagtttacagagttaccaaacaccaaaaatagaatcacctgacttgtcccgtccttaatccccagcgtccaataggtaaccaagttgtgtccatgacctcataaatgcctcttcattcattcttttcttctctatgtatgcagttacatagagaagaaaagaccatacagaacatacagagtgtgtctgaagactacaggtgatttctgtacatcctcatgtaggccttagtttaagagctgctcatctctcaccaggatcttcttgactgtaggctccatgagaacagacagcatgtctgtttatgcatctagggtttattgcagcacttggtacatggtaggtttttaataaatatttattaaatgaatgaataaatgttaaatggacgaccattgattgcaacagccattctgatctctctgcttccaatccccccacatcctttcattctcctctgcattgctaatattctcttcctaggaaaattaacctcactcattcattctctctctgtctttctccctctctctctcctcctcctctccccccaacacatagtcacccacacatacagtcacccacctgacctgcctcccacacacacttagaatacacagagtgtagagcttagaaaagagctgactccagtgcctagagaacaaagtccaaattcaaataagtatctaatcctctaccctacaagtggtctcccagcctcatccctcgcttctccccataattctgctggatcatgtgccatcctcaagctataccaaaagccacagtgtcccctaacataccctgacttgtatgcacgtgttttttctctcctgagcagtccagttgttttccaaggactgtctccatttaaaatctctccagaatgatcttcttggaccctggagaagctatcttctctcagtgctgccctgcgctcagtgcccactgcttttgtgctccatatttacatcaatgtttcaccttgctagagtgtgagttttaaggacaaggactatatggtagtcacatgtatattacaagtcactagcacctctcctggtacataatgagcacttgccaaattaattagaccaaattcatgaattagacccatttattacccgtatgtaacaagcaacaaacaaatgggggatgtcagtgacaccaaaatgctttctcttgcctgaaagtttataatttctttgcactctgttaaaactatttcgtggtttttttcaaatattatagaaaatattcatcaaggtataactcaaactcctgccaccatgtctgccagcagaatgtcagtagacctgcttcaataaattgatagcacttatttataatttgcagcccccatttgcatgcaaataatgtgctacagttcataaagttgatttttctcttaagttaaatattctacctacaatgttgttcatgtatcaattaatgaagttttactatattcaacccataaacatttattgagccaggtactgtgctagacccttaggataaaatgacaaataacataattccctgctctcaagaagctcactgttgaaaaaaaccaacacacaagccaagcattacaatgagacaggcttgtttcttttcttacaagggcaaaatgtggacgtttacaagagaaggtagagaaaatgaaagctaaaaggtagcagttgtaggaatacttatcagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggcaccagaggattgcaatttcatccagcatgatttttattagccttgcaatttcttaatgggctcccctgagggctggctggtagaatcctgcactaccagtccggatttgctacaggcagcttaataaacatggtatcttccccgtgacaattgtcataacatctgaccagggtgcagaaggcagagctaaaggttaacaaaaccactgctcaggtggcagggaggtgagtggggagaatgttggaaattgtaatctgaaggcaaaggctgcctgctgggttggtgattcttccagcctggccagagctcccaggagccgagcaggcagcttgctgccttctataatcagcatcttttacacatctcatcagtgtcactgttcctgacgtctcattatgcaccagaggtggaagtggacaggtaccgaacacttgaacttttacttttcttattatttccatggagcaccatgaagctgggagttaattaagtcccgtgggacaggcaatcagtgtcttttttgctaagttaaattacattatacacagatgcaaaaaagaggagaaaaaataatccctcagctgtttcctagttaatagagtaagttagaaatatgatgatgccaaactggaagctgaagttgatagctccttagcatacgaggtgtctaatgaagtcatatgacaaatccaccagggatctccttccttaaaggatctcaaagcacttttacaaacacttttaaagaacttcctgcctcaactctgacaaagttaattgggggatgatagtcaattcgatagtttagggaggaaattgtactcagccagactggagaagaaaacttccttggatgtataagatgttagactgaaaagaaaccttcagaggtaagacagaatcagacagtgtcaaagtggaaagggagctaaaaatgacctagcccaaaatttcccaaagtgttccacagagagccaataggtgttgtatggaagaaaaaaaaataagatttttatgaccaaataagcttaggaaagactggtttcaacagagtaaaactgccttccttcctgcaggactctccaagcttttaatgtctgactggacatcgatagaatcgagtctgcagcattcaccaaacttacttcactacagaacactttttttctttcttttttttttttttgagacacagtctcgctctttcgcccaggccggagtgcagtggcactatctcggctcactgcaagctccgcctcccgggttcacgccattctcctgcctcagcctcccgggtagctgggactacaggcgcctgccaccgcgcccagctaatttttttgtatttttaatagagacggggtttcaccgtgttagccaggatggtctcgatctcctgacctcatgatccgcccacctcggcctcccagagtcctggggttacaggcgtgagccaccacgcccagcccagaacacttttttttctaatgagacatgtttctttactaattgcttacagaattcacattggaacatgttgattttgtccagttacagatggggaaactaagaggttctttggttttgtttttttgggtttgttgttgttgttgtttgtttttttccttgagacagagtattactctgctgcccaggctggaatgcagtgcagtggcataatcatgactcactgcagtctccatctcctaggctgaggcgatcctcccacctcagactcccgagtagctaggaccacaggcacacgccactatgcccagctacttttttgcattatttgtagagatgaggtctccctatgttgcccaggctggtctcagactcctgggcacaagtgatccaactgcctcagcctcccaaagtactggaattacaggagtgagccatctcgcccagccatgaggttttccccagacgtgcctccaagcacacaggtaggtaacacccaagccttgaattaggacttagatcagccaatctcagaccactatatcataccacctccctctgtaacttaccaggaatctaaaacaccctacaagaatcaggtatgctctctggtcaccctgcgtttctttgtattactttcagaatactcatccttcatcctttttcacctgcagtcttaagacacctcatttccttatgttctcacccctcgtggaagcactgcctgtcatgtaatggcatctgagctccaagagaacagcagctacatgttttagaactcaccttacctgccatcaggccacagctcagcaagactagagttctgactctgatatgggatctaaggagcattttatgagacacagtggtggcaacaaaatttataaagcctctaacagctttattttcctcctgaattaaatctacactccttagtttggcactcaagattgtacatgatgttttccaacctttgtttctagtaactgccttcctggttactttctttcaaactttacactccagccaaataaaatcacttaaacgtaaaccatgttttcccatctctgggactctgtaagactagtctcttagctagtagacctttgttccttatcttcccttatccacatcctggtaatccttttaggccctaataaaatgccacactctctagggagtttccaggtaatttttccacccagaagatttctttgccttcactgattttccataacaaaatacacatatctttattatcacatgattatattttgcttatagcacagttagtgagtttttatatctcccctattaaatagtacattctacgaggtaggagttgtattttatttctctgtagacttaaagcaacctcccaaagtccaaagggatggactagttctaacattctagatattgaatgcataattttatctaggcccttcataacttcatagtttttggttgtctctcaaaacaatcatctgaaaatccctgggagggactcagacaatgcctgggaccctctgagtgatctgtaaatcatgtttcagaaggattaaagaacggcaatttttttttttttttgaaatggagtctcgctccgtcgcccagactggagtgcagtggtgcaatcctggctcactgcaagctccacctcctgggttcacaccattctcctgcctcagcctcccaagtagctgggactacaggcgcctgccacgacgcctggcttttttttttttttttttttcagtagagatggggtttcactgcattggccaggatagtctcgatctcctgacctcatgatcctcccgcctcagcctcccaaagtgctgggattacaggcatgagccaccgctcccagttgggaagtttaattaatgtttgtatagtatttggggagatgaattatgagaaaccgacactgtaacagactatttctttccctagattgctcttttctttattattagaggaaggttctcttgcatagaactgagtgatcagccatccccgttgggagctggtacatcataaaaatagctgctgtcattttgaaacaggaagacgcacatcacaaaagaaacacctaactgactttaaagtcctgcgggccactgaagatatgtgtgttttatgtagtcattatgctttctcatttggttgtttgtttgttaaaagcagacattcctactgaattctaagggagacttaccaaactgtttccttttcatttacctgacttatacagaaaaggtgacttgttttcaccccctcaaaatctcatgcaacagcaaggccttaagttagcaaaaggagaagtgaggagcatcagaggaagtggccttagtgtagctataaagagaaaagcaaggtcattgaggtcaagtgtttgctgacggcaatgtccattctccagctttccacttatcaacagcttcaagacttaccttccaggcatcactgctaccatatttttacccaggtatttgggatgggattagctctattctataagtgcacagtgatcactcattggccaaaaccaatcaacaaagcccattaccctgagcagagggaattttgcccaattaactcaagttggatcaatgagtcatgaagacatatttgttggggggttctggggaagaaatttccttcttctgaactgtgctcatgaaagaccctttcattcccatgtgatacgaataggaaagcaagtaggcctagaagctactgacaaccacattgtggccacagagaaagcaaccttaggttgaatctgacactctgcaaggcagggaagagacatggaaagagccatctcattagtgagccctgagctgctggatcaagccattcctatgactccttagttttcctgtgctgtgagccagtataacatctttatcatcggttctgtgagccaatatagtctctttatcaaatgatttgagtcatttttcccttgtgatttaagtcttcataacaaatttttttaagtaaaatttaaagagaaaaaatgaaagagcataagtttggaagctatctataaacagattatagagagctatggaaatggatgtaaaatatattctttatttgaggaaagtttcttgatgcacaatattccagtgtgtttcttagaaggaaataaatagagacttagcacaggcagaaatgccaagaatagtcatgtctccccagaaacttccactgtttgcaacaacattacaaagaaagtgattaatttctcagtactagaaaatcccacagaggatcttcagggcatcaggactgcagatgagggtggaaacacatcaccgatgacatgggaggagagtgggagtccagaggatgaaaagaggctgaatgatatcaaatgtccagccacctttcctcactaagtcccatcagtcgtttctgcctaatggttccatctcatagcttaacttgtcatacttgccatcaagaatgtaaatccagttctgattccctgtagactcacagaaaaactaattaaagacaccatgtggaatagagtgggtctgccacaaggctgcagagccacttgttaaaaatggtgtcatcagttaagtctggctagattgcacgtggcgataaataatcccaagttttcagcggagcaatacaacaaaagcttatgtcttgttcacacaacatccactacagatgttggcaaatctcttggacagaacaactgtcccccatatgttgaggacgtatgttcagcccacactctgggctatttagtcaacacagaaaaaaaaaaaaggctagagatttgagctccagaaattcagtgcttctacccacattctatacaagtcctatggccctatcaaacttcaaaaggctgggaagggaagtgcttccttgacctcaaaataaagaactggatattggagatcactgtcacagagggaataactgcaaagctgctgcaaattctcttaggtaaaggagaaaaggagtctaaaaaatcaactaagtatccattaatttgaggaggttactagcacttaactggaagtaagggaactcttcaaaatattccaagttattctgcatctcccatcaaagggagaacctgagaagactagtttagtaattataatattctagaaaggagctagagctttctttgtaaaacctatagaatcaaggcatgcctttcctgttgtttatttgtttgttttattgtttattttgtttggtttttttccctttttttaatgtatatacccttcagggtagtttattccctcattaaatggctacttttctcttttatcctctagaaaaaacacatttcctttcttctggtgtagctgaaatgatccattggtgtgtattttatggacaatatcttctcatctgcacacttttctgctgatttacatttatgttggctccatggagagatacaaccagaaagggactttgtggcattgttgggatatccacaaccctgccactagtctaccatcagctaactccagccaaggacagccaggggactagaagaggtgttgcctaaccctcctaccagcaaagcaattcaagaagacagtaactaaaataagctcttagaggagttgtgcctacacacccttatttgacctgcccgaggagattagctcaaagctggaatgcaccagtggaaaaagaacagaaagtggaaaaagcctatgcctgaaactaccattttatagagttaatgcaagttaacatccactcatacatacagtaataccattaaggtcatttctatctccaagtaacagcctttatctaaaaccagttcaatattcttcattcctcccaatgctcctgcctctcccttctggttccccttcttttctcctctaactccctgagacacaggagtttttgtttttgttttttttctgagctgattttcaattcgatgaagtccgtttccataacacttttaatatctgaataacccattcatctttacccaaatttcttcaccttccaggctccagctgctctgcgctatctggtcaaggttccctacatttcctaataaagatgtgcatgttaggagcagttactgtggctctttaaagtaagagcagacttcagtgctgtgggaataaaagcaaggtctttggaggggaagatttatggctgaatcaacaagaattaaaaagaggacaaccctgaggagaaaacccaagttctccaaattgactgaattgccttttgtatctcaaggctgagatgattatttgtttttgcaaatagaaatgctatgtatattagactcaaaactgataacatattagagctttcagcaaaataaaaaatgtttaacatgtctagtatagaaccacatatccaaacactgatgaaattcatattactccttactcaacacaaatacacaacacataccacaaccaccaccactaacacaccacaccacatataccactgaaacccattcaactactatctgagacccttcatacctgggaaaggaacctactcatagttgggtgcctttaattcttcatcaggcttcagggagatggtagtttactactatgcattcaagaaatggacctgtggaaaagcaagcttttctcgcacatgaagaattaaatatactgataaaataacatattgacatatcacagttttcacattctgttactaaggacttccataaaatctttccatgtcgctggtcgagaaatagcaacttgagattacaaaactgagttatccagtcacccaatgagtcagcaagtaaactaatttgaacacttctggttcttcaattaccaagcctcacctcccctgtagaatccaaagaatccccatgtgaggccattgtaccatctatagcaatttcatagcaagcaggcctctctgcaggatagctaaagtttcatatttggaaaggctcagaaaaaaaatgtaagcattatactcctatagtcaaaaacaaaaatcccatgacatatggtttcattgagaaaattacacacagtatttatttagaaaaaaataatttcaatttatgaagttgtactttagaaggaaataaataatcatgtcacattccaataggactaccttttgtctgtcattcatagggacattttcacagggctaataaagctcgcggttttccactgagcacagaaactgttattttaagataaaagttaagagtagtgtagctgagataatgcaaactcctatatggtgatgtaataattactcagtgatattataataaatttaaacacattgtaaagaaaaataaggacttttgggagccaaaatatgacaaacactcatcaaaaccacagccttatttactgataacatatcttgatatgagaggagcaggctaatatcataaactcatttgatacaaagagtccctgagaaacaaaagaggcacaattaacttgttcagatgagtttaagctgcattcaggctaatttcctgaattccctctttttttccaattagatatatttttatttatgtgtttgcagagtgtacagtttcaaacacaccaggggactgtacctaaatcatttttataatatcatatttaatgggaaattcaaagttgaattattttaacattgaatacagaaacccattcatatgattctaaatacttttggcatgaaatataactgtgtcattgctgaatagttaaaggtaacagtttatttcatattattagatatagcagacctgccattccatttctataaaataaaaatgcattataatgtttacattgattaataataataacaatacattaatagtagtaacaacatattacctaaaatcattggtaataatgtcctagggcaagaagattgtacaaacctaagaactagattttctttcaaatctttcatcatactcttgagagaaagacaggggaaaaggcaagaatttcttcctttttttttttttttgagatggagtctcactttgtcacccaggctggagtacagtggtgcaatctcagctcactgcaagctccgcctcccgggttcacgtcattctcctgcctcagcctcctgggtagctgggactacaggcgcccaccaccacacccggctaattttttttgtatttttagtagagacggggtttcaccgtgttagccaggatggtctcgatctcctgacctcgtgatctgcccacgtcggcctcccaaagtgctgggattacaggtgtgagccaccacgcccagcctccttcttttttaaaaaaagaaaaaaacagcaagaaacagaggtatgcaaagtcttaagttcaaataattgacaaagcctctttcacacggcaagttctgattatgacaacaccaccataaacaattatataaattgtgacactttaacttggcataacaatttacagagtactcacagactgattatctttcataattgtgtagtctcattatgtatttaaccaaaaatgataatccctggcacatttccagggctgtctatgaatgagacactgcgttaagtgcactacatgcattaattaattcttacaaccctacaaggtaggaattaacagactcagtgaagttaagaaaatttgcccaaagttatataacaagtaagtagaaggatcagcctcaaatccagttttattttagagtccaagctcacaactactatatcataatgccattgttgaacttttaggtttctcctactattatacgtttataggtactgtcttcctccctccaaaagctggaagtcagctagtaccaatcaattgaaaggttaagtgagttgttaaacagttgtagtcagacagggacattgctggaattagaagagaggccccaggagtcctgttcactgtgcatcctattctgactaattaccctaagaaggcaaagccctttcagatgtgaaactgtctgcctttccagcttctcctccccctgaagtaggtaattctcatacatttggagcctcatttcagggagaaaatacaggcacaagggactcagtaagtttcctccaggacagccaggtcaggggtcaatggttgagtttctataccccttttccctaatctaataactagctcaaccctgctttctgcagcacttctctctgcaggcacacaaccctgaagatgcacactaagtgggtctaaaaggaaaaaaagaaagaagggagagaaggagaagacaaggagggaaggggagggaagacaaaagggacaaaattgttttttgatttctgtaataggagaaacaaaattaattagggaataaaaagtattttcaaattagcctctaaatagctatgtatattataaagaaaatattaaatttgtcacatagctggattgcatgaatttcctagaagaatctccttaaacaaaaagtggggataaaaataagcagtgtggtttgccttttaaacagtaatccagtacagacatatatgccttcatccatccattcatcaaagaggaatccaatatgaagctcactctcagagagtgtaatgtctatttgggagtttaaatatttaaataaatacatgtaatttaaatgtaaaagagataaatttcttaaaacaagtataattaagaactatggaatttcccaagagaaaaaaaattcttcaactttaagaaaaggagaatcttcctaagggagatatgcattgaagagtctaaatgaattttaaaatataaatattttggaaaaaattatgatgacttaaacattagggttgtctgagagctattttgtagtcactagaaaaacagacgagatgagaaacctgtggagtcttggtcttgtcaaatcaagtaacacacttaaagaccacagctttaatcaaagtacctttaacttaagaaaatgatctctagtactaatgatagtgagctgtgaacatgaggaaggtgctactcaaccacaatatttatctgcatctcccctttcccttcctacttgtgatctataccagttgcctgcatttccttgatactcatatactccttaaccccccaaaatctggtttttctccccaccaatattgtcctgtggcctcaaatgtcactaaggacctctttattgcggtatgttttgattagtctcaacacacattccttcaaactcttccttcacctggattctatgacactaccacaagaattttcaaacatactgttatcaggagaacctttctttcatataagatcttgcctagaacttcaactgattaccatagctttatagtaagatttaaaatcagactgtaagtcctccaattttgttccttttcaagatagttttggctattttagattattgcatttccataattttttaatcagactggaaatttctaccaaaaaaacctattgagatgttctattgaaattgcattgacttaaatgttaatttggaataactgacatattaacattattgagaactccaataatggttctctttatgtttcttctgctttggattcattaagcttcttagatcggtgaatttgtagttttcaccaaatttagaaaatctttgcatatttatttatttagatttattttattttctatcccttctacctctcttttccttctgctactccaatgacacaaatattagactactttatattgacttagagattactatctatccattttttcccttttctttctgttcttcagtttggatagctttgattgttttgtctacaagttcactgatcttgtcttctgcaaggcccaatctaatattatctagtgaaattttcagtacagatattatttctttcaattctataatttttattaatttttgaaatagttttcattttcctgctggaatttcctataacttctcttgttgcatctttgttttcctttaaaacctttaatatgcttataacagttgttttaaagtccgtatctagtacgtttcaacatctctatcatccataggtctgttttagttgattgcatattttgctttttttctcaggttcttgattgtatgctggacattgtggatgccatgttcttgaaggtggagatttttttatcttccttcctttaaagggtgttgagctttgctctagcagacaattaatttactgaaataacagtttaattttgttaagccctgttttcaggatccattcagtgggtctagagtagctttactccagagctagaatattttattcctaaagtgtggcctttctgaggtctcaactcaatgccctggtgttgagtggggtttctccactctaatcagtcagcatttgaaatcttctagtactgtgctgttccaaagtactcccagtaccttagaggctatgttcacttcaagcctcccagtagctatagcctgctagacctcacagaaatatactcactacatgattggttaactatttggcaaaggactcaagggacccctgcagacttctagagttccttttttgcacagctccctcctctctggtatccttccctgcaaattccaccaatattagcagccctaaactctaatctctgattggaaactgagagcacagagaaatggaacccaaaaagagttttttgggtttccctgaactcaatctcagacagaaagccacattccttgactattgagtgtgttgcctctccattccctctgccatttccctgccccagttatctctcacctagctgagatgcttctacctctcgtcggtttaccaatcagttcatccatacctcactgccagattaatgtgactatagctcacctttgatcagtcactgactccttggggattacttgtcacctgctgaatcaaaggaccaaatgcttaactctagatcacaatccaatcctagcccacctttccaaacctacaactcaccattccccttcacacacaccatgctccttgctattcctgtgggttctagccttgctgccttgcgcatgctggttcccccaccagaaatgcctttcctctgcatgctgaatacctaaaccctgtccttcatagcatagcacaaatgccactggcgttaatagagcttagttggctgccccacctgaagatgacctttcccaactccgagcccctactctgtgagaggggaagagcatggcatacacaacacttcccagagtgaaggcagcaggacagatgccagccccaagagaaattctgggaataaagagttccacaggcaaagtttaggtaacagtccacaccacagcactccctagaaatccacattatgtattcacgtattgaaggatcgcaaaagtcctttggtaggaaaacctacgtaacttttttttttaatttgttttggtttaaacttttattgccaaccttgaaaagcaacatattaaccagttatcttgtgataagaggacaacttgccatttttcttagaatctagtaggcagtcctgcggccctaaagcatgtgggagtggctttttgctcacttggctgtacccctcaatgggaggaagcaatggaaagaaacgtttagcttacaaacacatcaggacctcaaattaagttgttgagccacttgatattctttaacaaagtaagtactgatcttatcaatcttcccacactgcctcacgccctcccatctaggtcactaaaaaattatatatatatatatattttagacggagttttgctcttgtcacccaggctggagtgcaatggtgcaatcttagcttactgcaacctccacctcctgggttcaagcaattctcctgcctcagcctcccaagttgctgggattacaggcaccaccacgctgggctgattttttggtttgttttttgttgttgttgttgttgttgtttgtttgtttgtttgttttgagatggagtcttgctctgtcacccaggctggagcacattcgcaaaatcctggcttgctgcaacatccgcctccagggttcaagcaattcccctgtctcagcctcccaagtagctgggactacaggtacccgccaccatgctcggctcatttttgtatttttagtagagatggggtttcaccatgttggccaggcttgtctcgaactcctgacctcaggtgatccacccaccttggcatcccaaagtgctgggattacaggcatgagccaccacacctggctgaaaaatatatttttttaattttttatttccgtaggttttgggggaacagatggcatttggttacatgagtaagttctttagtggtgatttgtgagattttggtgcatccatcaccggagcagtatacactgaacccaatttgtagtattttatccctcacccacctcccaccctttcccctgagtccccaaagtccattgtatcattcttatgcctttgcatcttcatagcttagctcccacttatgagtaagaacatacgatatttggtttaccattcctgagttacttcacttagaataatcgtctccagttccatccaggttgctacaaatgccattaatttgttcctttttatagctgagtagtattccattatatatacataccataatttctttattgactcgtttcctgatgggcatttgggctggtttcatgtttttacaattgcgaattgtgctgctataaacatgcgtgtgcaagtatcttttttgtataataacttctttttctctggctagatacccagtaatgggattgctggatcaaatggtagtctacttttagttctttaaggaatctccacactgttatccatagtgattgtactagtttacattcccaccagcagtgtagaaatgtttccttttctagtgttccaaggttcccacacaaggaattcttgaatttggaacagggacctggattgtagtcctgattaagcacttgttggtgctggtcttccccacgcccagataaccatgcatcataatactggtggcatgtttttcccaggccaaggtagggaaattgtacatcccaacatgggtagggtaaccatgtatcacatatgtatgacaagttgttctgttcccaagcccaggtagggtaatcacacaccccaacaagggtgacatactatcccagcataatcattcattgtgaaccttgcactctcaaaagcatcctggtttgggtgataaattacatagtcacttagttataagccctccacctatagacttcattatatccagttcctaaatcaaaccaaaccaccctaacaagagtagaatctagaattaacaattttcccattatacagaatgttgtttttctggactccaggccactgtgtgccagccatagttatttcctaacttccaccatattgatccagtcgatgcgacaggacgtgtgcctgagactcttgttctattctttagggtcccattggagctaaacgcagccataagttcagactgagtttgccataaatccctgccattgttccctcgtgtgcttctggctacttgatagggccctgctcccaatagactgttcgaaactatgacattatcactaacacttgagtgtaacacatcacatctgaaacctacaatgatggtacccatctcctctttaccccctcaggactggagttccctacacactggcactagacacattcctagttcctaaagattaaatggcttacttcccccacaatgactatagccacatgggttatgaggccagataactaccggtgtgacctttatcaaccacccctcattatgaatctcagttaactcatctctgaaatgaactggccggtctgtatggcatccaacattccacccagctgtgatgaattgactctatgtacccttttttgaaacttaactacttccacataaggcctcacttcccaaatatctcttaaaagtggggtctctttccatatattttttaaatctccttcagaacatggtagagaaccttgaacatggttggaactcaaatgtatgtcacataaggatttttaaatgagtgaggcatttaagcctaaaaaaaatcaaaattagactttgagatgatgggaaattaaataaatctaagaagtgaaatgatctggtcaaagcagcaagcactatagaaaaataaattcatatcattttctagcactatgactagtgaactagcactgccaataatggctaacattggacatttaccatgtgtgagatgcagctctcagtggcgcacaccaaccctatgaagtgggaactattattgaccctactttacagatgagaaaactgaagtacagagggtttaaagaacctgcctaaagtcccccaagaagcaagtgatgtattcaaacccgggcagtctagctccaaagtccatgcacttaaacactaggtcagcctgcctctccctctttcacaagcatttgcacatctaagcatcccaacaacaccaggttattacgcacccagcagaaactgaggcccagagaggcttaaagatcacccagtgtcacacagcagtctcagcgcactacaatacacttttgaaatgtcactgacagctgactgctgagaaacaggcgcagaataaagtggaagtgccactgggggtcagcggctctggagagaattaaaattggtagtaaattgaaaggaagaggtgtttgtgggggacacgatgaagcgagaagtgacagccccaggctatcacctgaagggaaggtcaaggtgagggagaagcctgcagaggccacagagtggacagttgaggacccaggagcatggaaaggtaggcacggaacagtttagtaaggacagaaaaaaaatgttgtttgccatcgcatacattttcagcaccagtacaaaagttatagaagaacacacattttgaagccaggaagctgacttttggattaggacagtttgactgcagcagcattcacaagagaatctggtacggcgagtgccacataataggcactcaataaatgtttgttccaaataaaagagacaaaaagagaaaaatctgagaactgctttcataaagagaaaggcacctaagggagtaggtgctcaataaatattattttttatctttgtgccgtgagaagcctggggagctgtaaaagattatctgatccatttccaaagagccctgagcctctgattgcaattctcgcaaattcccggggaaggctgtggaattcctctctggagacttacaaacatgcttttagaagagccacttggagggagtggtttagacaatttcaaaatgggtgaattgaggcagagaggctagaccgaatgaccctgaggtccttttcgtttctgatgtccacgtaatcccctcagaagctgaagtttccactctgctcccccatggcacagagatgaaccgaatggacctgcagacattgctgtcccgccaagctgaggacggctgagtgatttggaagccttccagtaggatctggttaaatcgtaggccatttattttgtgaagaaataaaccacagagagcccctttcaaacatgcatacagaaatcaggacaaaatgccaagcagattatctgctcagaatttgctttgaaagagcccgggcaacactcatttatttttgagaaaatatatgattaaccagagttaactatgaattcagatattgtgcattagaccagcttctcaaagtttgagcacatttaatattatatatcgctgccatttggactaaattgtttttttaatgtacacaatattacaaatttaatttgagctgtttgaatcagtctgtaaaaaagatttgattatacctgagtgttctggccccagcgtttccgtatctcagtaatcttgacggtaattggctgattgggcgtctcacactccatctctgcctcagtttccatggtaatgttacaggagctattatagatgagaacttcatctctttccaatttagggctgaaacgagaggggaggttaaatggggtgtcatcaatcttaatgaaatgcaattatttttactcttattaatcattgcaagccattagcttgtggcaactacaggccaccatttgtcaaattttgcaaatttctgtaattttgtttccattcttttattgtttatttgtttttccttttatctgcacaccctgcaatgaaaatgcaccatggtaaatatctttcactgaggcctttctcttttccgaatctattaaaaacattagcaaaagctactcctagcccagcttaacaagaaatgcagggacaatacttccagttccaaaaagggtaacaaacgtctgggagagtttttgtttttattttttttcttttccccttccctcttcctgctcttactcatacttagtgttgggggagtaattgcctgaatccccctagggcagatggagaaattggaaaacccacacaactggctaactggtccctaattccaactgtgaaaaaatgagctcatttaggcttgcaattcccccttcccagctgatggcaatgaggctctgttgctagcagtggaacattaacttagtaaattaattaaacttacttaacagcccagactaaggagattcaatatatgtgccagttatactaccagccactcgctttaaaagtcctcttgctttaaggggagaagccagactggatttaaaataaaaaacagcagtgtagcattacagaaagtctaaaaatatgccatctagaggtgaggacatggatagtgaagggtgtcatcctcaacaggtgtgatatttattcaagaatcatcctggctgtaggcatttttgcaactaactcaaaaattatcagtaataataatgcatgatgtttcatatttgtcaacaatttcacatgtatgatctcatttcagcctataaattaggaagaggtgtaaaaagtgtaacccaaagagatcaagagattctcagaaagtcaaacacagaactacggtagctccgaggtcaaaaccagatggtcctgtttcccagagcagtgctctcaagttttgaaatgctgattgaacatcagccaggaagatggcagatcccatgggaagaccaggaagggtggagagaagggcaaaaaggtcaccacttgagaaactgtacaccatgtcaaaccctaccatcttttttcaaatcaatgtcaaaatgttttcttccacaattttctagaaataatgagcaggataactagtacatctcaccacttaatcttcgcttcttcatgctaaaatattctccactctgtatctacctaagacatgacttccaaacccacagtcctttagacctaataatgtagactgtcaatatgttaacatcatgccacccatatctgaacgcagattgtttgggctgaccactgggactccggtctgcctttatctgagcctccttctcacggtacctgatactgtgttcattttgaaggccaccgtgcttatacttagatagtggtcaattcaaagtctcagagctgcagctttctgaggatttcaccatggtgtgtttgttcaaatgattttctgaggagcactggcatgtaaagcttaggctcagaagcagatcagctggatctgaatcccggggcagatggttaccatctacatgacattgaagacattacttcactaagctttggtttccacatttataaaatggagttgccaataatcaagtacctattttgtggaggtgttgaagaaactgagcaaaatgaagcatataaatagattagcatggaacctggcacacaatacgaatccaataaaggcagctcgcgttatagctgttggaggtagtagttttagtagcattattgttaaaaatgtaaatgtggaaatttacatttattattgttacatatctctcactggtttagacctgttgctcaaatttgttttgaatctgtagcctgctatctagctgtaaatccattcgctgatccttcgtccacagggcagacaaagtcacaggataaatccatcctttgctcctggagcatcagtcgtattccaagattcagaaaggaaaagcaaagtaatttaacttttaaattaaaatgcaatgtaatatttagatcaatacagaaatgtgatggaatcaaatgcaaaattcacgcagacttttaaaacacctcacttcagagcaacttgaggcttgcatcaggccactttgggctttgcacctagaacctttttttgttactgggggtggagaagtggttggaatagtttgtgaaggtctcccgctatgtttatatcataagtcacttataaacctatcagaaaggaaatgaagttggtttcccacaccatcacattcttcgtaaatcggtttccagatggctactttcatttctgaaggctcacaaactatctgatgaatagttcattctagaattttgtcagggataacaccaagcttagttgtctaaatttccagaattcctcctcttttttttaggttcatagaatatctgcccatcacctctgttatgtgaccccttctcatggttcattgccagcaataggtcctcaatcataagagtgagttttttgtacccagtttatgaatgatctgagactacagacttgaactcaaggaaagtagtgaccaacttccttctacatcctttcttggccttgggcttccacttgcctcataaaccttcttatgccctttcctgactcttcgctggcagaggtacaagtaaaatgggctgagtcactctaccctctgtttgcctgttaggaacacactgttttcactaagcatgttattcttgctctgaagagaattaaacccctttctgttagcttggactttttgtttaccagcttcagctcacacttttttccatatttgtaactaccttgctagaaatgtttttcattaaaaagccatcaccaaaattagctgagacaccaggatatccaaaataggttaacatttacaaaatttcaaagcttctaaatagctagctactcttccatggtttcttccacaataatcctatgaattaagaagcacagttggccatatttaaatataaatataagcatatatatatgcaacataagcatatatagacagagagatcaatatatgtacagatacagatacagatatacatgcatacacactgcacacacacacacatatttactttgggggatatggtttaaaatattgggtaaaaatggtggcaaagattgttctagtatctaagactcctgactcccaaactattgttctttagttgatctgattagatcctaaagtaagcaagtaaccttggctgtgctccttaggataggtagggaaaacaatttgcaggcattttctctccctcacttcccctgaagttgcttcctgtggctctgaaacctcactgaacccacaaagctcagccagggctctcacactgaagctgccagcacagcattgcactaagcacactgcatcagaagccttgagttccagtctcaacactgccatggcttgactgtgtgactttgggaaattacttaatcttcacttagaagagaatccaaactctttactttggccttcaatgccttacatatctctccgagctcatctggggccacttttcctccttctcagtctactcccaccctcctagcctctgaacagtcataaaactcgacagttcttttgcatttgctgctgccactgcctcaccctccataaagacacctgcttctcttcgtaacataaaagacttcttcagagaagcctcctctgagtacactctctaaagtagcccccctttatttttctatcactttatagcacttatcacaacacgtgatcatcctgtttattatctgactttcttctctacccttaaggggcagggactttcatgacatccacgaatgagccaccagtacctgtcacaacacctagaacagagtagggatgtgatcaatactggatagatggatggatcatggatggatggatggatggatggatggagagatggatggatggatgaatatactggataaacagatggatcatggatggatggatgaatggatgggtggatggatggatgaatacactggataaatggatggatcatggatggatgaatggattgatggatggatggatagatggatggatggatgaatatactggatagatggatggatggatggatggatggatggatggatggatggatggatggatggatggatggatgaatatactggatagatggatggatcatggatggatggatggatggatggatggatggatggacggacgaatagacagggtataatttttgccacagatgcacttctccctttgccaaatgacatcaaaccccatagatgttgtggatggcagggagatacagcattgtgttccctggaaaaacacataaaaactcaatgaagaaaataaatatggtcagtactccaaccacctagagataggcaccatcaacattcttggatacatctttccagccttttctctagtaacctatgtgtgtacaaacatatacactatatacaacagtaggatcaaattgatatactcttttgagacctgtgattttcacttctcaatatattataaatatttccctgtctggttaaatattctacatcctaatttttaaaggtgacttagtatcatatcatttggatacattctttattactaaaacttgtttcattgcaaattttttttgatacctgaaacttcaaagaacatgattgttataaatattacacatttctatctactttcttaaaatcctaaaagagaaattgctgggtcacagagtataaagaatttaaggttattcgtgaatcggcaaattgtcctctgacgattgcattaccttaccttcccactggcaaaaagaccgctgccagtttcccccactctcatccccattaaactttgtttgtttaaatcatagggcacttattataattcttactcaagaaaacatacccacttttggccgagtgcagtggctcacgcctgtaatcccagcactttgggaggctgaggtgggcagatcatgaggtcaggagatcgagaccatcctggctaacacagtgaaaccccatctctactaaaaatacaaaaaattagccgggcgtggtggtgagcacctgtagtcccagctactcaggaagctgaggcaggagaatggcttgaacccgggaggcagagcttgcagtgaaccgagatcttgccactgcactccagcctgggcaacagagcaagactcagtctcaaaaaaaaaagaaaaaagaaaacatacccacttttgcctactgcaatagccagaacattgagcagcactattgaaatgatattcataggtaaagctatactgtcaatgcgttctgaggctcagttgcttcagccatcccatacaatgaagaggaagagcatggaagaaccccaaagaagagttttggggattcagatgaagtccctgaattcaatggagccaggacctactgacatgtacttcctggtgtccagcatcagtaagttctgaaatccagtctcacctgagtacaatacccagcactccatttcctgtgtgagctaaacagagttcttcttgcccttttagaaagcaaccagccaaggaggttcctcttttcctccagctaaacctaaacctctggtgccaaattcacactaaaacacaaactgtctcaggacatcacaaagtcagatgccatgaaaagagctggttatctctttcaccgtggggaagtggtcttgtttagtttcatattttataagaaaagaggcggggcacggtggctcatgcctataatcctagcactttgggagaccaagtcgggtggattgcttgagctcaggagtttgagaccagcttggccaacatgatgaaaccctgtctttactaaaaatacaaaaattagctgggcgtggtggtatatacctgcaatcccagctactggggaggctgaggcatgagagtaccttgaacctgggaggcagaggttgcaatgaaccgagatcatgccattgcactccagccttggcgacagaacaagactctgtctcaaaaaaaaaaaaaaaaaaagaaaagaaaaagaaaagagaccttcattagataatcaaaggtagccactctatctacgtaagacataaagaagtttacatgacaatgttcagtcatgagacactgccctgtataggaaaggaactccttgctgaaatgaaagcaatccagaattactagcatggtcacacttcttttttatttgtttagaaaaggggggttaacttggaaagttgtggtgtttatttgtcagcctcttttttaagttaaaaaaatgcttatacgcttatggcttctaaatcctagatctacagtaattccgcctatgcaaccctccttcttttgaataaacattgtacaatctgctggatttctctatggctttttttcatacttgtgaatctgtttggaaagaaaagaaaaaggaaagcggggaaaaagccttctgtttttcataacgtctaatctttttccccattggcattcaccagatgttgctttggatcggaagataaatattaaaatctaagcaagaacaaagcgagctgtttactgggcagatttttcagatgttctcttaaacagttgaaaaagacaggagatgctttgatatgcaggctggctggaatccacaatggaatggcccctccaagagagttgtagcccttaccacggctgccaggccacatccacccagcctacactctctgatggctccatcggtccattggccaagcatttgtggggaagttcagggagggagaaggtaaagttacctgataaagaggcccgagaatgatggaaacattgactctgcccaatgatctggcacaaagaggcattgggaactttcctcgcaaatgtagaggtaaggccacgattcaagcagttgctctgtcgccatggcaactgtcaaatcacactgcacataggtgtgtctggcagcctcacagctgtcctcctcacgcttcaggccacacaggaaggccaaggacactgcaggaaacagtcaccattaggaaagaaccacagagagaacctaaggcctctagtcggtttcacaaatgaagttcctgtgtcctcctttgaccaataggaatatgaagttagcagtttactttttttaaaatgtattgtatatgtgtaatgtacacagaaaaatacaagtatcatttttgtaaaatatgaataatcatcataaaaaaaactcaagtgaatttcccagccaacataagatataaaacacttataatacacttaaatctgtgtgtttctccccaagttcgtccctttcctcctcattctcagaaataaccacttggcattttttaaatagttttatcacaaacatttgtattcctaaacaagagattgagttttccttgtttttgaactttataaaatatgatacatgataaaatattcttgggtctgattttttcattccatattatattttcaagatttatccacattactacatataactattgttaatacattttcactgctgttcaatattgtattgcatgaaactaccacaataaatttatctattctcttatcaatgaactttttggtatttcctagcttttgctactaaaaacgtacaaaatttcatctagggtgcatgcctatcaagaaaatttcttattcaaagagtaggtacaagttcagctttacaagatagtgccatattgttttccaaagtagttgtgccattttgtattcctaccagccatatttgtaagttcccattactccatataattacaagcacttgaaattatcagacttttaatttttgccaatcaggtgtgtaaaatggcatttcactgtcgtcttaatctgcatttcaatcattacttttaggttgaccaattattattattattattattttttgagacagagtttcgctgtgttgcccaggcttgtggcacaatttcacctcactgcaacttccgcctcccgggttcaagcaattcccctgcctcagcctcctgagtagctgggactacaggtgcacaccaccacaccccggatgatcttttgtattttagcagagagagggtttcaccatgttgcccaggctgatcttgaattcctgagctctggcaatccacctgcctcagcctcaaaaagtgctaggattacaggcatgagccaccgtgcctggccaagttgaccaacttttttatgtttggtaacaactcatgttttctcttctgtgaaattcctgtttctctcatttgcccatttttctattgggttgtttgtcttattgacttggataagtttatgaatttcttgattttcacataattataaacattagcatgttatagagataaaaagcaagtatttgaagcatgctgactctcaggccatttttttctgagtcatgacccacatataaaaagcatcatgaggcagactgggaatgatctttaactagaagatgaacaaagctccacatgagatggtttaggagcagctctgtctgaaaaccttaataaagagggaaaatttaaaaaaatctctgtagcctgcttcctctgcagcaagcctgcccatgtgggtaatgcaacagaggttatcaagggccgtgggcttagacctgtgcttccccgcctcattacagtgctgtggcaagggttacatgagataagtacgtgggggagggtttgtagttatgcaatcatgcccaaatagtactattgttgctgttatattctaaagcacctggcacctaggaggttggctgtgaatgtgttttgaatgaattagagcaataaaaatgactgacagtaggactcttgtatgaacagacaaaacataagaactttccagttagtaagccctaaggcaaataaaaacaagctccacacctataaaataatgaattcattaaaggtgattaagtagatgcaaattgacaagcaggattatgaaaatcacccagggctggggatcaaaatctatgggttttactcaaagttctgccactaaatagctgcgtgaccttaatcactttagctttccatgccttatggaaaagttaaagtttccatgaaaatgtcatgtggtataattcaaggtataaatgcaagaaagccaaagatcaaagattttgctcattttaaacaaacacaaagtattagtttcacctaacaggatgttttggcaactcattacaagaaaaaggaaatttctcctatggttagaagtacagtttgtggggatggtaaaaatgggtgacctccaaaatagcaaaagcacatttgtagagccccctgctttaactccccctgccccacacatgtaaagaaaacatattagttctgtggcacaggcataaacaaaacaataattaagaacgtttgagttcagggtcattatctgtaacctggaatgtgaaacatcactctatggtacaaagtcaaactgaagaaaaaaactcaaagcacgggtcagaattcaaagcgaccttggtaaatgagagaagttaacagaaataaacaaaagaacaaatgaaaagagtaagacagtaaactacaaaagaaaaaaagaaatcatataaatatgaggaaagtccagctgtgcacagccatggtagaaatgcgtgcgtgcacacacacaccccttgggataacagtaggtaacagaaagcttattaaccagcaagactgcagtataattgtacaaacaaacatgggatcagacgatacacaggcatcttacgatgctacccaatttggccagaacttgcttgtatagaacagcttcctcatttggggcttcaaattaggaaagaatataggatttcagagagggctgaaaagtgagatactaaaatgtttacttggaaagtttctgattcagtagggcccaagaattcacatttctaacaagctcccgggtgaggcccttgcagctactgctctgggaagcacacttccagaactgctgccatagaggaactaagaatactccactttccaaagaaccacccgctgattaaggttgaaaaaattagagtaggggagcatccattaggcagaggatggatttctctgaaaagagcaactgcgaaacacttgtaagggttgctgctgggaaattctcccctgaaaaatctttaaaaatacaagtgatttttagctaacttggttgtactcaatcctgtctgaaaatggagaaattagtagtagtttctagtaatgtctaagacctatcccctttgacatttgatgtccattatagacctacttcctagggaaaaaaaaaaaatacacagtcatacactcaaaatgcttcatccagtttcagcgggttaacagaatccccaaatcccatcttggatcttaagtaagaaacctctggagttggctctcacaatttcctctcaatctttagacattgtgattgaaagtcttttaaaagacttttttatgaaaggaaaattagttaaattatgcattcctctagagtaaatgtgtgccttgcacaatcaatgagtgtttggtgacacctagtggccatataaatagttacagtttccaactaattttcctctttaaaaaatcatggaatgttgagttcttttctaaatctttctaaacacaataattattttattattcttccccaagaagttataaaacttaaaatatcacaacttacctgatcctgaaacatcattgatttttatcttatactagttgaaattaagtgttttgaaataataacacggggcttttaaaagtatattaatttgagcagtgtatatatgaaagcttttttaaaaaatgtagcagtattagttaaaaattagagcctataaatgtgcagtcttagctttctgtttatgctatctctcatttattcctcaccaagcactaattttgcacataccctctgcaacactgttcctagcagaggaggtagagcagtgaatcagacaatgttttgaacttcaatcttctattgtatcttaaatttcccattgtggactctatctctcttccataatgtgtttatatacatgatgataataggaaactcaatttctagcattttaacaaaaatttttttctcctccccttcttcttcctcttccctcttccccctcctccttcccctccttctcctctttgtataagacaacacagcacaaatttccatcacaatagcattatccatcattaaattctcatccaagctcagatgatgtggtgcttttatcattttgtaaatctttagcccacattcaagttgcagacaaataaattaggaataaaacttaaacactacacagaaaggaggtatgtaaacggttaagtgcacaggtacaagatttatgattaggcaaataaggtaatcacctggctaaatgtgagctatctcaaatgtagtaaggtcctgtagtaataacagtaatttcttccttttgactttatttcctgaagctcagtggggtattaccatgtgttgtgaatccccaagctttgcaacttactctctcatctctttccccacaaagacacggcttctcataccacaatttatatgatcactacgcagcttaaagtagtgagcaattgtggtgttttactgaataagaaataagtaattatgtgagtattgcaaaacaagaagacaacatgagtgttggctcttttgcctataataagaaaccgaaaactgaacacacaaagctaattttcaagtgatatccagcttgaaaatctccatccctttactggtacctccaataagcagatgtcttcagcaacctcacctcagaacaaagccaagagcttgtttcctccatgactcctatagctgtcattgaaactaatattcagaattcagaattacttcctctgtcatcctaagactgcagttaagaacacaggtgataagtgtttcaatattcatctaacattgacatattaatatgacaaaagttatgatgaatcattttaacaggtggcctcagattctaactatcattttagatgaggagtagagaaattcttttcctaggcacacatagagaaattagtagtcagtacagcattaatcacaaaaatagaattaaccaaagaatatcatttccatatatatgctttaaaatatatgtgtgtggcatctttactcaccatccaggggcagaaccaagcagctgaaggcagacactgtagcattagccaggactcggcagggagcaccacacacagcagctgagacattccctggagaaaatcccgctccaaacacatgcaccagccttccacccaggcagcctttaaagacaaaggtacaagttcttgatcatacaggcaaatctcccttctttactcaactcaaaattcaaacatttgcttcctcactacccattcttcttttcacatcctcagaatccgcacaactggcttgaggtggctgctggcctcagtttcctctccacttaggctctggccttgtctgactccaatcacattcaatatcctattgtgttaaagaggtttttttttaatgtaacaatttttatatggaaaattaatgcttatttatagtttttaaactttttattcaaagagccataaaatgaaaataaaaattcccccaaccatctgactccctccccggaggtacccaggtatagagtttcttatggctccttccagaatttttaagcatctatgtttctgattcaaagcattattctatccatattattctggaacttgcttttttgcttcaaagtatagcatagatgttttttcaaaactctatggatccagttcattttagtagctacttagaattccattatagggccctgctacaatttatttgacaattttcctatttattgaaatttccattttttctcctcttttgctattgttaatagtgatgcaataactgtacatgttttgggacatttgtatgagtaaaaccagtccacatttctagtttacactgagatacagagttcccctcactactgccttcataccaggtctaggtggtacttagccacttgactaactcaaaaataatgcttttggtttaagatgcatttcttatttccctgctcttccatcataaaaaaacatggaatcttagggagtagtgcctttatcaaataaggaagctgagtctcagaaaagtcaagcataaattagcaaaattagtgatagactagagccaaatcctagtccccacagtgttccaccaagctgagaccaaattttttctaagaaatgtcttagttagtactccaacagtctaagattctgtttctatagtttttttccttactttctaaatcacaaccaaatttgaactatctcaagtgcaacaaggctttaagtgaatagaaattgaaagcttttcttcactggagggaaaggctaggcaatttttggtatatctaaacggagaaaacagtccaaccaatttaattgttctgtgcatttggcttattattgttgaaatatgagtccacctgtgaaatattacaaaatgataaaaatttaatcatacttaataaattttaaacaacgcaaattggcagatagggtctaaaactaggtgaaggcatttacgttcttaaatgatcaaattatgagctcttacaaatggtgttatttaatttaaaatacaaatccagttaatgcatcaaattaaaatacaatcaaacatttagagaatatgcacagtttccttgataaaaataaaaaaaatcttcataaacagagcataacaaagacaagcctcaggaaggaattgggattgtaagaagccagtgggcttctctttccttccatcaggcagattgtgttaattttctactttccagaagtgaaaggagctaccaattcatttacataaagaaagtgtgctgtcttatttgcttgacttaccgaagttctccgtcactgctgtaataataactcttgaggtgaacaccagggcagatgaggcccaccctctgatgcagtcatagcctctgacgtggtactccccggccggaagggaagggaccacgcactgaagaacggtgtggttaccagagacacccacacagggtgacattcctataaaaatgtcaatgtttgcagctcctgagatctgggccactgcaaaggttaagatgtcatcgctctgagaaatagagatcaattctggggtaaaggccttgttataaccaatgactcctatgtgataccaaagtccatctacctctatttccagggcaacagagccattccctgtgggaacaatgcaccggatgagctcagcaccgatgttcaccgtcaggcaggtctgctggtcaatatagactgacgtggtgttctgtcctctcaggcctgtgccctctatggtcaagaggcttccaccatgtaagctgaaattcttaggaaaataatgaaacacttggggcataatgtagaagtgtctggaaacattaccagaacaagcatacccatttcttgtataaaaaactgacaggtagtggggtcctggggccaagtctcttgtctggcacacaacgtggcttgcattaaaaaaagttacattgcaaggaagttgatcatccacaaataccatcggctcatcagctgtggtggctaacctctgacccctaatcagcacagtggtcagagacccactggtgtttgtggacaaggcatccatgacaggacttgcctcttcccttatgaaaagagtgcaattcccctgacactcgctggttagcccattgaccaggactgtgacgttcagggagaaggaagctccaggcaaggggtcaccctccaggctaacctggcagagaatggtgtggtctcccaaactcaaaatcacacaagtaaaaggacccgagaggtcaacccgaactgacctccttctagagttaagaagcaaccccctcacagtaagtatggtcccaccacatgccgaaccctgcgatgggaagatggccattatccgaggcatcactgcaaattgctggagcaccacagacatattagcaaatcccatctgcttctgacgtacttggagaggatagatgccagcctccagactgtgaagagggatggagcatccagacaggctcacgttgccctggaaggactgtgtctcaacatcacagttcaggttccccagaaggatgactgagttggagaggttacttcctcccacatgcaggctcaggctgctatttgtgatttctccttgcatggcagtgactactggtgttgctgccgcttcatacatgaaggtgaagcctttccccaccaagcttggtgaaggaccacgggcgaagaacctgttgccagcccagacctccacggcagctggaacagtgggagcgcccgcatcgggtatctggggggctggcagggtttcacaccagatgctcgcctccgttaagttcacaatgtcacaggaccgattgcccacaagtacccaaaccaaagctgggtccctgctgaagcctattcctgagatgctgaggatggtccctcctaaagtatgaatacggaaagcaaaatattatagctgatattctgaactaagaattcatagcacctgtggaagtcctaggtcaattaagtggaaggtagggcatgtgttagtgaaacctcaattattttttctcacccccaccaaagctaaatttgtgattatttagacaggagtcagatgtggtaaattcacataacagtaaaataatacaaattgttatataggaaggacgtcttcaacacaaacttttcaagtacctttgtatatcccagaagccaccactttaatcaacttacacactaatgaaaaatcaaatttcttagtcttcttatcatgtattatattattggaaatattatcctgtatgctatatatagactatttgtacattgtcctgtatacattcaacttatatgctaatgaaaaatcaaattcattgaagtcttctatcatttatattgttctatataatattccaatattccatatattatacattctaatatattctatttattgtaccatatattctatattccatatacgtgagagacattaaaagtcattgaatcttgctggtgaatttgctgctaccttcatagaatctttgccttactctccagtagagaggccaccaaagatcaaaccccatcttcaggacaggattggagcaacatgacccacagcataaccaaactgtacaacgtggcttttaagaggattttactatacccaaaaaggataatgtgctatcttacacatgatcacaactattattgacatgccactagattgttttccattctttctgaaaatagttttagagattggtctatttgtcttgttcttccatctcccatatcagcatgtgtgtttctatttctgagtctttcatctgtctctctcatggaaagtgaagacccgcagattcaatcctcccctccttgcatgcacagcatctaaatggcgaatgcaggacatgttgcccttgtttttctcatatccactctagagtgtcacccatcagacgtttcatcctcttttcattagaaaagcaggcacatctcggctgggcacggtggctcatgcctgtaatcccagcactttaggaggccgaggtgggcagatcacctgaggtaaggagttcaagaccagcctggccaacatggtgaaaccccatctctactaaaaatagaaaaattagccaggcatgatggagggcacctgtaattccagctacttaggagactgaggctggataattacttgaacccgggaggcagacattgcagtgagccaagtcagcaccattgcactccagactgggcaacaagagcgaaactccgtctcaaaaaaaaaaaaaaaaagaagaagaagaagaaggagaagaagaaaaagaaaaaaaaaagaaaagaaaagcaggcacatctccttgtcataaaaattccttaatttcctgagcaaatgaatcaccaagttttaacacccttttaaaaacacccctcagttcctggagcccgaggaaagtttctctcctgtttcccctctctctgacctcactggcaaattaatccagaaacaaaatctgaatatccagcaaatagaattgctggataattgataacagtcacataagagccactcacccagcagggacccacagcaaggctcgatgctgaaaacttctgtgaggtactggatgtggagatcaaccctacagaagataggcagatgtttaggaaataactgacagagagagataagaaagagtaagccagaagagccatatgtattttgaggagaagagcaaactgtctgtaagttctctaagatttgttccaatgttatgatgttcatgtctttaacctctaacttccaagggaaaaagaaaatacctaactcaaaattagaattacctagctgaatgctagaccatcaaacaaatccaaaattaatgcaagtggtcacctcacccttgtgagtgaatgctgaccccattgatagagacggaaattctgtggagaccagctggcagtgggggcagtgccacctccaggccccaagccgactgtgtgtgaaccggagccaaggcatcctggacgtggacttccacatccaaatccgtatagttcatcagcctcgccactccaatgaccagggtctcaccgcctgtgttgagaagaatccaatagcctctgacatgtggggtttgtgggctcaaccatctattcaattctaaaactgtctttttggattaaattcacagtcacccctatgcataatactcttaagagttacgataccaacctaaatttttcaagaaacttctaacaactatttttttttttttttgagacaggtctcattctgtcacccaggagtgctgtggtgcaatcttgtctcactgcagcctcaacctccagggctcaagcaatcctcccaactcagcctcccaagcagctgggattacaggcatgtgccaccacacccagctaatttttgtattttttgcagagacagggttttgacatgttgcccaagctggtctcaacctcttgggctcaaccaatctgcctgccttggcctcccacagggctgggattacaggggtaagccaccttgcctggcttaacaactcttttaacagagatatggtctgtaacctcaatagtataaaaagaaaaattggcaggacaattgtattcaagagacactaacttatttccatgcaaaggcaaatcaagaagtttgcagagctaacggtctttataaccagcaaagagcaccacatattggttgcttaacctccacttttctactggtagaagtctgaagctatatttgagtgtgcactgaaccttacagtaatgctgtatgtgagtttagtagctcataactgacagagtactttcacgtatgttatcccacttggtccacacactatcctgatgatttatatggggcaattaatatgactggtattttgcatttgaggaaactaagctcagcagccacagcctcatagctattaataattactaaaaaagaaaaaaaaaggtcaagacctgagcccagtcttttgtcttgcatttcagtgtccttttagtttaattagcaactctattaaaatgtgtacactatgaacactttcatgcaatttcttttaactcaaatatttattgagtaccataaggaagatgctgcaaggggcacaaaataagttaaacacagactctgccctcaaagaagcctcaacggtagtaaaataggtgacaaaattgcttcaataaaagatatactacaagagaggtggaaattaagcactgggattgctcaaatcagagcaacattatgaatatcaggaaagatggaatgggcaagatgagagttgaattggagcttgaaagataaatccaaaaagaaagtcatagagaaaagggggcttatcatttatttctagaaatttcacggttttatccaaagcctttcatagcaatttctcacttaatcacccagtggcttggagaggaaaaagagaattgggtgatgttctggaaggcacaggtagggttctgttttggggataagccaagttgatggtagtcctagggccaaagaccaagaaagccaagccagagggatgtctgcttaactcagtggacggcagtgaccgccaaagacttgtaagcaaggaaaagatatgattaaaactgttcttccagtctttaagataaattgaaaagataggggaggagaaatccaatctgcagacaattgtagtcttaatcaagtagaccaaatcaagtgggcaacagcaggagtggaaataaatgtccttacctttcctgtgtcccagtgtggccactgaaacatggcttgggctaaagcatctctagctcctttagcctgtaacatttgaggactactgcagagctggtatctatgggatgccacggccaattagatgaagaggaaaaagaggttgcttgaaagagaaaagtcaaagaagagggatgtggtgtggtgggaagactatgaatctgcattcaaatccttgatctgccattttactacctctgtgactttgggtgatttacttacggctctcaaagccttggatttttcatcaataacatggttaataaagcccatcccatgtggtttgttagatatcctgggaaagtatctggcatgatatagcacacaaaaaggccttaattaacttcattttcttcctcgttccccattctcttgaccgcatgtcttcccaatctctactgggaagtctgaagcttcagtgtagtgagttcaagggatttcagggctgatcaaagaaaaagacatgactacgaggtgacagtagcaaaaaacaagcattatttgggtggtattttgacagattcacagaggaggaggaagtctcccagcatgagaccttccagaggcaacagtattgggccaccatccagaaagggaagaaggcaagggaactgggagggggtgggaagatgagagaggggggttctgtgtccagatgatgtcactcagcagcctggtgggtagcctctgggacagagagctccaaaggcatcagcggcttagggtattttatagccccagggttttcttacctacagctgactgatgggtgcagtttcatggggcatgcaaagcaagaggaatttaaatggctaaaaatatgcttattttggctacgctgaaaacaagtggatgtgtaaaagtttgaatttagcactggcaggcttttgagctaatggatcctggggtgccatgaagaagtaaaaaaaaaataggaccaataggcagggcctttctttggcttgtttataaagcattcaatatctggcagaatgatggcattcacttcaacaaagatttattggtgcttactctatgtcaattcctggaccaggtactttcatctgctttatttcctattttcatgattaccttgaaagaattattcccacctatcaaatgaaggaactgaagataaaagaagttaaatatcttacccaaggagtatggtaagttcaactaagtttggcctaaggctgtctctgtaccttgagtctctacataaagaactgcaacccaactttgtgataaactgaaagcctcaactacctgagcctcagttaatcacaggctgccaactgatcagaccatgctccaataaggcaaacagggagctgtttctggcctcacttccattttctgtctataaatgctgcctgcccatgtggcatagtggagctctctgaaccttttctggttctacaagttactatgattctttgttcaaacaaactctgttaaatttaatttcttgaaagttcttctttttaacaagtggttgagctgggattcatgcagattccatttttcctgactgcagaaaccaacactaatggtcctgcacatcaaattcaccagcactccccatccttggtccctcttatgcttttattttcatttcatctcagcctcacggtcatcatcaacatcatctcttggatggagatgtgcagcactccaacttaaaagaggcattcccaaaaggctacgacacttcgtggattttataacatgctcctttttattctgcttgtagaaagatttaaatacaagtataaattttgaaaagaatgcattgcattgtatgtatcaacaacataacttttggagcacttggtcaactgtcaagctaatcctagatgcttccttggcactgatataatgtatttattcttttcattacagataagaaattttattaaaagccaaaatcactgaaatctgaatataacatggagctccccctcccttttctacctcatcaggaagaatctgtaccactaaggaattttacacacttcagtcacctggggcagcaaattcttcttctgcattatctgagctgaataatattggaagctaaaggacacttctctttatttatgtactcttgagctatggaaaatgaaaatagtgccagaaaaattgagttcagactttttctttgggaaatatgatggtctttttacaataaacccttagatatggctaccacaaaccctgttatctggcattcagttcaccagaaagggaagttacctgctactcttccaaatctatatggaattacatgataataaattattataattctaccttgccatatcctctgaatcatcaaagaaaaattctttcatgtagttggtgctaatgaatccattatttttatacgtagaatgtctcaagaaacaagaattctaagttaatcagagcatcctattctctaatcatattaaataactgctacaatagaacctgctgtcaaaaagcagtattttacagttaactacaagtagataagtacttggtatatacaaacagatgacctgtgttcaaatcttagataaattacttattctctccattccttaatttcctgatctgtaaattgaagctaataatcctataaattaggggcaaggattaaattacatctattttatgtttatgctatcattattgacacttactaaatgctcaaggaacatattttgaattgtaacttttgaattcccacatccttttcatgatggaaatggtcccatctgtacaatggttccattttacagatggaaaagtagatatcaggagattgattcgatgatggctaagatgaaaaaagcaatctcctagctttcaagaaaaaacttaaatccaaaatacaataaatttcagaggacattgattgccctttttataggaccaatgctctaagaagaaaaagatcttgcagtatcacatattttacctgctatattgcttatgtttctgctcagagtcacaataactggatttaaggaagagacatatgtaaatgctctgggaagaactgcagaatagtcccctctgatcacagtcacattcacaatgcgtccatctttcccctgaaaaatcaattttaaaaattaaacctcagttttattttaaagtaggactgacttaagggaagagaactccatatagaattagttttaaaagttaattttaagaaagttgttcctaaagggtatatttcctacttccaagtctctctcttctctacaaccctgcacactctccccatcctgcccccacacccacaacacagagtgataagtgcttggactagtaggcaagtgcagtgttagatgcataatgacatgctgtaaggggtaaataagaattatttgcaattaacacaccaattgtttctgcaaaaatatggcaatttcaaataaatgtctatacctagctaaactatccatcaagtatgagagtactttcagacatgtgagaactcagaaaatttctctatgacacactctttcataggatgtacttatggttattatctcataaaataaataataatttaaatatatatatatatctgaaacccaagaaacagtgactactcaagaaagcaatcaaagtaagtactaggataaaatctgtagaataaacctagaaaataagcaggctagattgaaacaggagaacagagatagcttcaaggaaaatgaatgactgatacgatggaactttttttaaaagatattggatttaacttataagaaagacatgttagccaggcacagtggctcacacctgtaatcccagcattttgggaggccgaggcgggtggatcacctgagatcaggaatttgagaccaacctgaccaacatggagaaaccccacctctactaaaatacaaaaaattagctgggcatggtggtgcatgcctgtaattcaagctactcaggaagctgaggcaggagaatcacttgaacccgggaggtggaggttgcagtgagccgtgattgtaccactccagcctgggcaacaaaagcgaaactctgtctcaaacaaacgaacaaacaaaagacatgtttagaaaataaaataggaactctaggggaaaaaaaaaaaaaagaactataaaagaaaaaaatatactacccggttctgccagcatcatctaaatagttagaataatataaacaggttttattaatttaagataaaaatggtattgtaactatatttgaaagaattaaaagttgtttcaggaagggggacttgaagaagggggaggaggggcaggaaaacataatttactattttccttttaacctatgcatctatcacttggatcaaaagtaaaatttattttttattaatgtttatgttctctggtaaaagaaattaagaggtacatgtcttacccattaaaatggcaaatatatattaaaataataaagtgataacccagtattggccaaagtgtcaaaaatcacacacgtgcacaatgatggtgggagtataatttgaaagggaatttcagacaactggatactacatatcaaaagctttagaatttatattaatttatcctgagaaaagaaatgtacccccaaaacatagttattaggatgattaaagccctgttgtttacaataagaaacatttagaaattatctaagtgtctggtaataaggaatagttaaacaaattagagtacaaccacatattggaattgaatgtagtgtacatataaaagctagcttttcataatatttaaggaactagatgagattaaaatgtaggactagtgatcaaagaatattttgaaacttatctcccaggggatctttattttggggtcatgggtgtgctaggaatgttgatgctgcttaagtcaactctaaatagaaagttcagtggcagcagtgcgtgtgactctccccaacagtaccagggaaggacccagactcaaatcccttaataggccatgatatagcactaattgaaaggaaaggaagaggtcagggacttgtttttaaggggaaaaggaagcaatggagaataactaagaagatatttcttagaaatcacacactctagaagtttctaagttctacaattaatacccatactagaaaacaaaattgctgatgaaaactaagttatttgttgtttgcttaatagagaagggagactttgaaatatataagccttgcaagccaacacccagaatgtgcactagctaaatttatttgttacgtgtcactaatacttactgacagtacagaccagaactgcctggttgtcttctttttaagaaattaattgatgttaattacaagctccattggtggggtcagtttcccacttcatagcaaaacagacaatataactactacaagcatactatcataatgagaagtttacatcagttcatttagttctaagaagtgattcactgaaaatgttatattaacagtggtcactcacccagagagaaagagatatgaaaggaatccacttaccctgggtggaactttgcactgaattctgcttgaattgcttgtagcgacattgatggcacacgagtaagatccaaataatatcaggctaacaccttccaaactagagcctcggatggtggcccagagccctcctgtaacaaaaacagcatattcaaatgggatcaccaaccatacaggcagacaaaaattaattatgcacaagatggataaaatgaaattaaaatatgaaactccttagtcaaaacaaaggcaatgctcaaactgcaggaaaaaaactggagttaaatatataaactatcatatagaaagggagaagtagtgacaggagggcagagagaggtagcactgcatcctgaagtcttttaagaataaaacctaggaacacaatcgtgccacaagtctgaagaggtagtctctgaaaactcttcctggcctagattttgaatatcattcctgcaatcctataaaacatattcttttcctaagaaaccaagtgcaacagagcatcatggtggaaggaacagtggctgagagtcagggtcagggccacagattgctcagctacttttagcaggtcattgcagtatggtccctgagctgaagggtcaacattttcctcatctttaaataataatgttagcccttccagctttgtggtttgacactacacatactaggttcagttcactgtgaaaatatagaaatgagtggcatcactgcccatcgccatcagaatttctctactgatcactaaagagcaaccacagaaatccccatttcttccctgcagatgttagcaagaagagagttggctccagttctgctatcatggcacacgtttccatgtggaggagcagcctttgatctagctaatgtataatgattctggtctgccatctcccagatacaagagaggcagtgaggccaccaaacagccttacccccccttgagggtggggagggatgcagaagcaagactactttcaagcatgttggggacagaaaggggaatctacaaaatctgatgaaaacctttgaggacagtgtgactcggtggactagtaccctgaagttaagtgcataactaagagcaatatacaatcgtgatataaaatatacaatatctggaagcaaacttcaaaacaaaaattaagaagataaaaaaattgaaaaaatatttgaaatactcttgaagaacttaatggatggattaaaacttacataagaaaactaaaataaatggatcgaaagagtgaacaccataaaggtgacatatctttataaattaaagcataaatgcaatttcaatagacatataaacagaatttgtacttaaattagacaagctgattcttaagtttaatgaaaaataaacaagaatagccagaaaacaaaatttcaaaaagaagtgtaaagaggtcttctgccatatcttatacagtaactatggtatcaactatgtggtaaaataaaatatagtccagaagaaatgcagatcagtatgaggctatagattaggatataagtgacatttcacataagtgcaaaataaattattcagtaaataaaataagtaaatatcactgaaaaaaaactaaatttgaatttctaccttatatgcttcaccaaaataaattcccaatttatcaaatatttaaatattaaaaagaaagttttttgactagaaggaaacatggcagaatttttattttcatataatttcagagttgcaaagtctatcctaagtattttagaagtcctgaagccataaaaggaagatatattttattatgtaaaaattaaaaatatttacgaatttccaaaataaaaaacaaagagacaaatgataataaagggcaaatatccttaatacataaaatgctctttaaaatcagtaagaaagaacaataaccccattagaaaaaatgggctaaggagataaacagacatttcactgaaaaggaaacacaatgcccctaaacacatgaaaagatattcaatttctctctcaataaaataaacacaaattaaaaccacaatgaaatattcttcttctcctataaaataggtaagtgtcaaaagggttgggaacacaccgtgttagtaaaatgtggtaaataaacactcatatatgcattgttgcttaggcaataaattatgcaacctctaaagagaatcttttgatatttatcaaaatttttaatgcaaataacctcttgacccagcaattcaacttctaggaaattatgctactaatatttttgcacatgtacaaaatgggacaactccatatacaaaataacaaagttggaccctgtttagggctgaattatgtctcccacatccccaccaaaatttaggttattaccctagatcccaataactccaaatgtgaccttattcagaaatgggatcttagcagatgtaattaaactaagatgaggtcacactaaaaaaaagataagccctaatccaatatgactggtgtctttataaaaaggggaatttgggccaggcgcagtggctcacgcctgtaatctcaacactttgggaggccgaggcaggcagatcacaaggtcaggagttcgagaccagcctggccagcatggtgaaaccctgtctctactaaaattacaaaaaattagctgggcatggtggcttgtacctgtagtcccagctactcaggaggcaggagaattgcttgaatctggcaggcaaaggttgcagtgagctgagatcgcaccactgcactccagcctgggcaacagaatgagactcggtctcaaaaaaaaaaaaaaaagttggcaggggtgtgcaagggggaaatttggacacaagcaagacacagggaggataccatatgaaggtgaaggcagagattggggtggtgttctaccagccaaggaacaccaaagattgcctataagacaccagatgttaagagacagacatggaacagagtcttcctcaaagtttggttcagaaggaaccaacactcctgacaccttcatctcagacttctggcccccagaattatgggacaataaatttttgttgtttaaaacactcagtttgtggtacctgattgcagcagccctaacaaactaatacagacccctacctcataccatgtacaaaaattaactcagaatgaatcaggtacctacatctaagagccaaaactataaaaccctcagaggaaaacataggcataaatctttgtaacattggattaggcaatagtttcttagatgtgacaccaaaagcacaagcaataacaataaatataaactggacttcaacaaaattaaaaatttgtgtgcttcaaataacactatttttaaaaagtgaaaaggcaactcacacaatgggagaaaatatttgcaaattatttatctgataagtgattagtacccaaaatactttaagaacttacacctcaacaataaaatgacaaataactcaatttaaaaattggcaagatttgaataagcatttctacaaagatgtataaatggccaataagcacatgaaaagatattcaacatttttagtcattaggaaaatcaaaatcacaatgaggtatcatctcatgcccattaagatggctactgtgaaaaataataataacaagcactggtgagggtgtggagatattgtgatatggtttggctctgcgtcctcacccaaatatatcaaattgtaattcccaatgttggggaaggatcctggtgggagatgattgcatcatgggggcagatttcccccttgctgttcttgtgatagtgagtgaattctcagaaaacctggttgtttaaaagtgcatagcgtacccctctttgctctctctctcctgtcactatgtgaagatgtgcttgcttccccttcaccttctgccatgactgtaagtttcctgaggaatccccagtcaagcctcctgtatagcctgctgaactgtgagtcaattacacctcttttctttataaactttccggtctcaggtagttctttatagcagtgtaagaatggactaacacacattggaaccctcttatattgctagtaggaatgtaaaattatgcagccattttggaaacagtttggcaatccttcaagaagttaaacatggagttaccatatgacccagcaattccatttttaggtatatacccaaaagaactgaaagcatatattcctgcaaatcattgtacacaaatattcatagcagccttattcataataatcaaaaagtggaaacaatccaaatgcacatgatgagatggatggaaaacaaaatatggtatatccataccatgtaatattgtttagtcataaaattgaataaagtactgatacatgttacaacatacatgaaccttaaaaatatcatgccaagtagagaagccagatgtaaaaggtcacatgttgcattattttatttatattagatgtctaaaataggcaaattcacttagacagaaaatatatctgtggttaccagggattgggaagagggagaaacagtgactgactactaatgtatacaggttcctttccatgatgatgaaaatgttgttgaatcaggtggtgatgaggtatacaactttgtgaatatactgaagactgctaagtttatactttttaaaaatgagttttatgatatgggaattatatctcaattttttaagttaaaaaagagatccttggggtaaagaaaagaataaaatatcctacctatttctaaggtatactaccctaggccaagccaacattatctctcccctggatgtctgtcatatcctcctaaccggtcttgctggttccatctttgcctccctactgtgagttctcacacagcagcctaagtcagatcatgtcacttcacttgaaatcctccaatggccaccatctcactcagaataaaagctgagtgagctgagggccattcatatcccccaaggccatataacttgctttgggtcatcttctactgctctcccctcactcaatctactccagccatggcaacctccatgacattctggaacaagccagtctaactttgactcaagactttttgttccttgatgttccttctgacttgaactgtcttccccaagatttccccagaattcattccttcacttcacccatatctcccttctctaaggccactcatgtcattcctccaatgccaatgactataccatcacaaccatctactccatccctcttcatccccttcccttcttgatttttatcctatacacttaccatcactgccccaagaacagaggatttgtttttatttactgtatccccagcattaataatgcctggtaataaaagctaaataaattgtcattatgattattgttgatggtaacaattaaaggttgaagaggtgatgatatcttgccattctcatttgaaagtttagactatggccacacaagagtccgtaccttaaagaagacaatgctatctcagcacaaaaatgaatgaagaaagtatgtaaagcaaagccaagattttcctcaaaaaaatcctttcaagggttttgcttctgcaaatgggtaggtggtgatttatcacattattgtatccattcattacatatgcaaatattctgtaaatttcttgctgataggccccagcctggttctctttaaataccccagagcatcatttctcaaactgtactcttcatagagattgcctgaggacatgttaaaatgcagattaattcagaaggtctggggtggagcctgagactctgcatctctaacaagctcatgggtattacagatactgcttgtccaggaccacactttaaggaccaaggtcttcagcacctcacacagggctaaatgggatgggccaatcagtgttgagtgagtgagtactgattaactcataggtggcagggcaaaggaagaattaatagaaaaagtttaaatccagtaataaggaaagcagcagctagagcctctctctctccctctccctttccccatagtcttaataaaagataatttctacccgcttggcatatcccttctcagagttttccatcttttgctaaaataatgtacaatcctcctagaaatcccttcactgaacagcatgttctgatagggtaaccaactcactccaattttcctaggaccaagttttagcactaagagttctgcattccagttttaaaactgagtcttgtgtcctgggaaccccctcagtcccaagcaaactgggaaagttggccaacctacctgtgcaaagcactttgtctaggggaaacaaaaatgactgagtcacctgtttgccttaaggtggagggagctgaagaaggtatgtgtggcctgaacagcaaaggtaactttgaaagaagatcaaagccccttataactctatagagaaaactacactatgccctacactcaaaccaataattactgggttaatacagaatatgatctttcactctgagctccatatatcatctgaccttccttaaatcatggagaaataagtgcaagttatgcttgctttgttttatgtgcagaaacaaggtggggtgggcctcataattcactcttctaggcaaaatagggtcagaaaaaaatctgttcttttgaacaatgagtttgtggccaaaccacactgcttttaaatatgttctaagctgcagtcctctggactccagaataaaccatgacaaaaatccaaagcattaaggaaaagggctttatgctctaatgtttattcgttaacaaacataagcatcagtattcctgagattcttgcaatctggctgggttgtttttaactggctgtgtccctcagaaagcagaaagtcatggagaaatatttgattttccatagaactaacccaattcataaggctatgttgacaagacccaccaccctctgtattgcccactactcaaatggcaatcagttttccatgctagccaagtatcccagtgtgcatcagttcacaaacttatgaaatatcaaacatgtatgaaagttatgtaggacccaattatgcctgacaccaccagccaaactataatcctttatgtggcaagtgagttcatttaagggctcaaatgtttgttgctcatttaaatacttatgtcagtaaacaaaagacagtgagtcacagtgaatatggaattcattacacagaaggactagattcctatcagcaagaacactagcttcagagggtcagacatactgtgagaccctccccagattaccaatatccgcagctctggaaggctccaccatatccagtctaggtttcacatttaggaagaggtcttctccagtggcactgatggcaagaccagagggtctcaccaacatcaagatccgatgcattccaacaggtagcaaatctgtctgacagactacattggtctggtttgagaaaataactttgcaactcgttttgttcactgtaacctgcaagaactgggagtcaccagagaaaccagttccggtaatgtaaatcattaggttgatgtcaccatcttaaaggagaaaagaaattaaaaaacaaataaaataatctctcagtgatattacttcatttgagagacctctcactatcatcaaatgttccttctctgcccccatcccctcccaaaattcaaggagctgaatgctgaattaaatattggccatctgtatttgttattgtagtacacagccccgatcttaaattttctctaactagtgagaagtgatcactgctcaattttttaaaagaacataatatttcaaaataaaggacaaagacaataaaacatttttagtcatcaaaagtccatctctccccatttcaaatcatgaccatatcccttagatggaccaaaaaatacactttctgctacgtcactcaacctctgcctaatgaactaatttatcttctacccacccatcaccagctacatggcctctaacaaaatcactgcaagtctccggcttaagcccatctcagagccaagtgacaaatcataccaatggagtaccacacagaatggacacagggagttgacccttggaggtactggaaagagcaggaacctgggcaatgagctggtacatcattcactcgcacaaccacctgaaatgaggcaaaatttcttttccattttatgcatttcatatctaccagggtattcataaagtatatgtgaagtgctcccaagctgacacgtgttcatgattcgctaattcttattccttttttctatttttccagtaattaatcttaaattgcaatgaatggctcaaaacacatgaagctttcttaaaatgatggtggacatgctgaaccccatttctgtaattaaatgtgataaatattgagtaaatttatctctgtcatatagaagtaaacttcataaacttaaactgcataaggacttcttatcactctgtatttccaaccaggtacctactttatgtgacaagctctttatttgctagtaaagaccaacaaatttggtgcattccttccaccactctgtgaatatataactaaagactagagtgtatttggacactttacttggggtctcttttgtcacagaatggtagattcctaaagagagactatatatctttccctttcactggaactaatgttaatctaatagaactcaaaaactacttggaaatgagaaaggtaaaaaagatgtgaccccactgattctctatgtataaaaaatgcattaatagcatacagattatattcatgacagtgtttccttattaaaggaagaggtattgcaatggcatggacaataaagaacacttcaattttatctgtactgtttcattttttccataaagacaaaaaatataaatatatcagaatgttgacaatgtcaattttcagtttgggtccccaggtgttgataatattattctttattgtttttgtattttaaaactttatcaaattgaaagtagatgacctataacagaaatatggaaagataggaaaaaaataaaaggactttttaaagacaaaaagaatgacttagctcatttactttttgataccaccaggtagaagcataaatcatatttagctatagaaattatcaattttttgtaccataacaacagtatcaataattataatagaatattgtggttacaaggcatttatattttcagggaactgtacataccctgtggaggtagaaaaaggacagccataagtacccctgttttacacattggcaaaatgacccttaagagctaaatcaatgagtccatgttacaaatcagtgaggagtgagttagacttgaaactggagcttgcacttagggtggcccattcactctcacctgagtatgctggttggcagtagccaacatgtctccaaatatgggtccaagaaaaactccaccatcatataccacacgcgtggctgcagcaggattcactccagtaaggttttcatcagagacctgagatggttacatttctggtaaattctgtcatggaaccgaaatctaatctcgtctaatcaaataataaagagttttttcacattgtgtttcagataatcagacagctagaaagtgaaagcagagtaacagagaattgaaatatagaaacgtaacagtaaataatggctgaggaaagtcccagtagattagagaaatattcatttgcaagtggattgccaaaagaggtacaataaatcaatcttctctctaagtcttgagacactttgcttctccatgcttttccattttatatgtttgcaatccaaaatattaaaataaagtggaaagaaacagtgccatgagataagagcaaggtctcccattcttcctccatctcctttctagaatttcgattgaaaaccagataacccacaacaccatacaactaggaaaaattttcatcttgggcttcattttataataaccaaatgctagttgatcattagattattttttaagaccctaaatatgcaagagcatctggttttgtcattacccaaagacagcaaattcttttctaaaattccttctgctatgccatctgcttccacaatcatctaagtcaatcacatctgcttaaattatccaataacagatgtagaattattgcatggtggacactgaccaataacttcactacctacactgagttaggaagggagatgttgggtttaaattgctttttcagggatatgatatacaaaatatgtgttgaaaacttccagaaagaaagttcatagaatccctttactcaaatattccaacaaaattaataattcatgacagtttccatttgtataattctgatttttttttttgcagaatttctccagggcagcaaatccatgccactagaagggatactatacataccctgataaaattgggcaaatccccaatctgagtggaccaggacaaggtccacacgtgttcgtagcaagtgtatagatcctccttcacagtgaagtcactggcattgaggtacctggatgtgaagtcatcggcattattctgtaagagctggtgaaggtgatgagcagaaatttgtacagggacatctgtgagagaaggttttgatacagaaaacacagacactaattaatccaccttacagagtttcatcctcaaggataacacgatacatactaggatgcctatcaaattttcaggagacccttctgtcaaagtagaacttcagtagaatccccagccataattaaaccattttttcctaaggtaaagacaagtagatgcccactttttatattacactatctttcactcataccatatcacacagcaatcagagagcacagccatgtcagataaaaccatctcaactgtcaactcaaaatgtaaactccacacacccttgtaatgcctgaaagcataattaaatattagatcttccctggaaaaatttagctggccctgtgaacagagaaaaattggccacttttcacagggagtgagggaggcgtacagcagctgacacccataaaaacttggccagcccagctgaggaatgttggcatttaacttcagtttctctattagaattttctttaagcccaaccacctgcttccccattccatgtccccacagaagaataacagctctctgtatttgaaccctgctttgtgctctaccagaagttcccatttcattagctgctcccagcagccctgtgaggtgggtcattgggtatcctaatgtctactttagggatgaagaaaatgaaacccaaccatatgcagaagcttgccaatgcagaaagacaggtttacatgaaaacacaggttgccttctacctactcaagagcatttctcttgaattccacgctgccctgaagggctaataaaatatcactgcgtttctaaattgcaaacgaaattgttatccttttacaaatcatgtttctacatttatacagagtttcagatccatcatcattcaaaaggccaggccaaggctgactttcccagttgttttgcaggcggtgatctgaggatcatcagtgatagaaatcagtagcaggaagtctctacggatgagctgtcttccatgagaagtaaaatcaaatataaatagcacagtaatgagcctcatagaggcagggcacgattgatgttttttcccccatttaccagaatcaacacctagggatcttcgacttctcctgagtcaccctattataataaaaataccactctgttcctctcacccaagaaggtcctgtgcaggcctagggactttctgcttgggagggcaaaagacttttggaccatgttccaacttttatacagcccctctcaagttctactgagccttgcttctgattccccatgtttctaccaaataagtaacgtatcattatcacttctaatctttgttctttgtgcattgtatgtattcttgaagatttacaaacactactctaattgcatctgaaagttctttctacatttgttgggaccactgaaatcctccatagtacatggtgtcaccattaagtctaactctgacggaccatggctaccatgtatcttggtctataaaactctagaaagaagaggactgacccaggaatcaaatacctgggttcacaactggaccctgtcatcagctatttgtatgaccttttggcaagcttcagtgtagttggctgaacggtgaaccccctaaaagatggcctaatggcctaatccccagaaaatatgaatgttaacttataaagcaaaataataaactgcatatggcaaaagatgtggctaagggtcttgagaggaaaaatctgtcctagattatcccaggtggaccctaaatacaattatataataggtacccttataagagagaggcagagaaaattttgagatagaagaggaagaagcaacgtgaccacagaggcggtggttggagtgatatggccacagccaagacatgctagccaccaccagaagccagaagaggcaggagcaaatacttcacaggagtgtggccctgccgacaacttgattttggacttctggccccagaactgggggagaatcattttttgctgtttgaagccaccaagtttgtggttaactccttacaacagtcccaggaagctgatccactcagtttccacaactatacatcttccgcatctacaaaatgtaaaggttggggtagcattaacaataagtccctttccaaatctttcactttaagaatgtcactttcagacactggaaaataaataaaatagctttaatattatcacctgtctgacaacctcccaggatgttgttcccttgggaatgtgagtgagaatatgtgagtgagaattgttgcaaccccaatcacccctttaccagaaatcactgtattaggaagctggatgcgaaagtgtcctcctagaggtggacttgtccgctgtcgtctctgtgtcgtcaccaggaccagtccagatccctcttctgttccttcagtgggcacagagctgtggcacgtcagaaacaaagtattaacgtctgggttggggtgtgcacctaggaggaccttgtctgaaggatgtcctgtcttgcttaggctgcagccttccagaaagagctaagggacctgaggaaactcagtaagggagttttcaggaccactcgatgtgagaatcatttcagagtaacttaattcgtgtctatcatttcagagctaaaaacgttggcatttagagcctaccgatatggtgggcttcctctctgccactgaagatgtctcacctcttcattttcaatggatggttttattgcttttcctgcccagaggaccatggaacaaacatttagtcaaggaaagtaaagcacgggttcaaactttctgcacctgcctttaatatgccattgcagcatgctgtaggtacgagaactcattttggaacatatgagaaaaagatgagagaaagaaacctatacagttatgcatcacttaacagtgaggatacattttaagaaatgcatccttagacagtctcatcattgtgcaaccatcatgcagtttacttacacaaacctagatggtacagcctaccacacacctaggctatatggtatagcctgttgctcctaggctacaagcctgctgctgtactgaatactgtaggcaattgtaacacaatgctacatatttgtgtatccaaacatatctaaacatacaaaagctacagtaaaaatatggtagtataatcttataggaccaccatcatatatttggtccatcaccgacagatacattgttatgtggtgcatgactgtatatttagacatatatgtgtatacacatatatacactgtgaatatatatatccctacacccacatatacatatacatacatcaaaggcagagcactcaattcttcccattctactggggtttaggtgaaaaattaaaagaacaaattagagtatacatgtgttccagaagcttagaagaagcctgatccttagttactgctttgtaaactgtggctagaaatggttattatgaagcaatgcttatggggctttagtgccatctggtggtgagttcttagaaatagctatttttcttctctagacatttcatttcaaaggatttcaacaagattaacacatgaggaatgcaatgaaaagaacaacaacaaaacaaaacagtggtgatgtgaacctctgaacagcacaaaatgccactatttttaaactaactgactcggaattagttctcaaagcgtagtccccagaccagcagaatcagcatcaccaaggaacttattaaaaatgcaaattgtcaggtttttccccaaacctactgccttagaaactctgacagtaggcccagtaattttaacaatacttccaggtgaatctggtgctgcattctcaagattgagaacattgctttaagcaacaagacaggtagcttttcctgaaaaaagtcacacctgtgtccctcaaggccaacaagcattcttaggagaagggacaggtgtaaaaaagccactccttaccgtgcagtgatgagcgggagctccgtgccacaccccgccagccaggaggtgacactgtagaccggaggggatcccaccacagagactgattccaccagattgccccctgggcgagccgttccagaatcagcttgagaaactagagaccagtgatccaattactatcaagtgacttaagatggtagacttgctgtgtggaaaatcccagttggaaatgtgagttactcagatctcagtacacacctaaagcatagattcctacttatctgctgccataaagaacacatggagaggacgcaggaggataagccattcagtttagtacaaaaaggaaagtgcaaggtcctgatttaaggagatgaagattgattccatagaaaagttcaataaccccacagctagtaaaatgtcactccctatgctcttggaggcactcctacacagttaatctattgcagtatagcctgccaccctttcctcctttccttcccacagcccctggcaactctagggatgtttagctgatcctcttaggagcactgaactcagaggcatacacaggggcacttgggtgtttatccacagtgtggagccagcatgtgtgcagaaagggtgcaagctttaagagagaccactggtcaaatcctgattttttcacttctattggattcccactcagctaatccacacacactccataagactcagttttcttatgtgtaaagcggggattatgacatgcatgattgatagcaatcaatctgacaaggagagcttagtgagatttaagatttaaaatgatcagcacaatatcaacatccttttagcttcttccccaagattggttacaatggagactttaaagagtttaagggcaacacctttgtctaattcgtcttctcatgcttgatgcttagcacatgctaggcatagactaggtggtcaataaatgattacttgctcagctgggtagatcagttcgagggtcagtgatcattagattccgatctcctccacagctccgctgtgtgaattggggcaaaatactccactccttttagccttggtttccccacccataggtggggataacaggaccaactcatgggcttctgagaactaaacgagaaataaatggaagctaccactatccagtggtagtgggagatacaaagaagtttcatagaggacattagtcaggggaatatcatcaagtataaaattgagatcagataaatgatatacaattaactatgaatattgagcccaattgtgtagtttatgttgccattaaataattctgaaaacaaagccattgccagcagggttaatgtgataaagtgggaggcagaccgtttcatgtatgctacccccatcttccctcttgtctccgccctctcccttcctgctcccacctcacctcacccctggatgattccagatacacagagaatttggtggcaaagaggtgagggcagtaagaaaaagttctgaatccttggcttcaagtgtttggcgaggcagaatggcattaaagggagagaaaagaaaactgaacagcacctattatccagtcctgagttttccaactagtggactccagtgtatgaaatattgattccctcagccttctggaaattgaggcagcacttggggtcaccaaagacccccagccagttgtcttgggcaccaaaaaattcaggcagtcacccagcacgtcacttgagtagtgtcattttctaagtgtgccagagcacaaacaggtttggaacaataagcaatgacccagatgtccccaaaacacttaaactatggaaacagaggagagatgggattttgatgagaatcaaagatgatgtaatttcaaggctgataaagagtcctcttgccacccatccccaagttcccctgccttcagtactgcaatgtttaggcaaaagactgaaaagttgtacattttctaaatcaaaatgtaaattaaggtatcatctttttcttcttggagagggaaataaactataaaaagtaggctagctgagccccaaagccacaagggatttgacagagaaggaaacatgagcaaaagttggaagcctgaagacactgagggcaaactgcaccattctgccttggctgtgggcgcacatcacacacagacacctcagcagggcccaggaggaggactttgtccctaagactagcgggcaagagccaggtgagaccactgtgcccaagagtggtcaagggagagttcgggaaggaagagccgggcctgatctctaaataatgagtaggaagagtctggagagacagaaaggacaagggccttctctctgaagaagatgattaccttctaactctcactgcgtctgtcttgaaggttgtaaatcagactcttggcccatttacagagacagacactgctgagttccttccagcacctggtatgacatattaactcatggaaaggtggagaaatcctgctagtctaatgataacaataataataacaataattgcttatatttattagacaccttctatggacaagaccagtaaggagtactttatattaaactttagttaatcttcaccgtaatctaatgaagtagggtccttattatacccattttacagatgaagaaaccaagacttcccagcaagaaagtgggaaaactggagtaagaatacagacaccagaagtaagagaaaatcgtggggaaaataggaaagaagagggactagagagacatagtaccaaagacacataatcccagccccatctgttttctagagccaaggcaggcaaaaaggaggatcacctgttctctcctcattaaaaaaaacagtaacccctagcaggaaagtttgaggtaggcatgtgaccggcttgtggaggagagagaatttgatgattacctgttacgtttgtgtctgcaataataatttcatccacatagaacaggcccgtctcctgggccagagggagaaggttgatctgatgaaccagcactggggagtttgccggagggggctggagatccccgaagcaacgcacacaagtctcccagaggtcagtgcaatcgaactgccagctgaaaaacagcatggagcagaactgggctctcagggagcacttgcagtcctctccggttagagcccttgttcccaacctggggggcctgtgagctatgcagccaggagagagaccccatgaacccctgcacccaagcagtcctgggtgccaaggctacaaacatcccacccaagatgggatcagctcagccttggttataatgctagtagtcaccttttaagtcaatcattcatccatgacatgcaatgtcagcagcattttcaaattacagtttaactgtgtgtcttaagcaaattataatgtgaggctgtaaccacagagaagattgatacttctggacattaccagtttcatttaggtttaagaccatttacaagacccatgagaattatgtggaaagcactgaatcaagggatcaagacagctgaattttattccagggtcactagctgaatgaattttgatgaatcacaaattcttggggccccaaatttcctctttctgtcatgtcaaagaatgttctctaaggtttcccccaactacgctgttctacaattctatccctatgagaaatgtcagactccctctagggagtagtatattcttaacaactaactgctctggagtcaaacttttttgtcaaataaaatatattcaaatccccaaattagtgtatgaggcccaaatataagaccattagtgcctgaggtgggtaactgtccccaaaacagtgaatcctcccagctgactgaattcccaccacgcctccccaccgattagctacctctcggggctggtcctcgtgagactccagtcacaggtggtattctttaccatgttttgaaagccgattgtgaaggacacaatcatcttcaggatcttgttcatgtggcctttgtatgcaagacacagctatggacaccaaataagtccttcagttctattagtgcaagaagcagtcattcaaacaatacgtagtgaggagtccacatccctagaaccctgccataggctctgagagagtcagcacagttcctgcccttccagagcttaccagtgtagccagagagacaaataacttaaattgttatttccctacctaaataaagctaaggaaaaatacaataaatactttttctgagaccaaaaaaatgtcatcaaacagagtttttaaatgcttagcactgtgcttggcagtgaggattttagagtatctcacttaagaaaacccctgttctaacccaattacccgtgcaacctcgagcaagtaactcaacctctctgagcctcagttcctcaactctaactccccagcatccttggtttctaactcagttaaaggcaaagctgttgccacaagaagactttagagcaggagttttcagcctcggcactatcaatattctaggggctggataattctttgtcataggggctgttctgtgcattataggatgttcaacagcttccctggcctccacccaccagatgccaatagcacttccccagttgcaacaacgaaaactgtctccatacattgccaactcttccctggggggcaaaatcacctccactgggcgcccctgcagaagagatgaggctgaagaagggaggagctcaagcctgaaacatttagccccaactcccacagcagcccaactaggaaaagactagaaactactgccatgagctccaccactccagcaaaactcactctggttcccaaagggcaaatcagctgcacttcttttacaagggtggtggagctatcgaagcaaaggatttaagaagtgtttgcgaaatgcatcagacaattcaatccatcaataatgacaacaactagagtaataataattagccttcactgggtcctaactgtgcaggcactttactagattatctcatttaatctataccacagtcctgagagatagaccacattactgtccattttacagatgagtaaatgaaggcatactgtacttaagacagacatggaaggtacattgggtgtggaatcaggatttaaaaccagatagtccaatgacacagtctgtactcttagagatcaaagaaaatattgtagcaaataaaaactttcacaagtctcacagctaatacaaaggcatttccaggtaacaacacacaagtgggggccagtggtgtccattcatacctgaaacagcagtcgagagacctagaacctcagcctgaaacaccttgggcagatcacagcaatcactcctttgtgcttctgagttttcagtcttgaatccagagagcaataccaatacctacccacctgacccagaagcacaaagactgctactcacgtgtgtatactgatctagccgatagcccttctgggcagccgggggagtaaggacaaggtgtcgaggctgacggaggctgaacctgccacagaagggctccgtcccactggtgaggtccccatcagagttggaaacttctgggcctggatgcagttcagataaaatagaaaggcaggcatagatattaaaaaagacagagcttccctacatgtgtgcatgaggattttagagtatctcacttaagaaaacccccgttctaacccaattacccatgcaaccttgagtaagtaactcaacctctctgagcctcagttcctcaactctaactcccccagcatccttggtttctaactcagggacaaagttgttggcacaagaagactttagagcaggagttttcaacctcagcactattaatattttaggggctggataattctttgttgtaggggctgtcctgttcaccatgatatgggcccctcagccctgggaggaatggccacagcatgagtggtcagcacccctggcttgaaagctccagctataagaaactcattctgtgttccctggagccttgaaaaccctttagcattttctctgtgtagcaggatacggaaaactattgagaagcaaaaagacaaggaatatcaagatggaagaggtgttcaaaaataactagaatttagttcgccttagtagtagttttaaaaacataccctaacattttaagaatttcttaagactactttcttaagtagtaattcctttagatgtaatctgaagattagcatggttttggctatgtttgcatgtttctcacctatgtctttgaccttttcccaccgtgtggcatggggagtataggagggtgctgcactctacctaacagcccaggaggaatgcctttcctttctattgacacccaccgagcatcaacctcccaagcacagtgcagtgccagtccctcagccactcagtgtccaaatccaggtttcatattttttttttactctgttatcaccttggagaggaaatggggattgttctcattttatagaaagaaagaagaccatgatgaaaaagacaatcagaatgaagccacggacagcacctcgttcaaatccaagccggagaaggatgttagaccaaaggggttccagtttgcattttactgcaagtaactcctcaatggttgtttgaatctattacaaaggaaaaaaatgccaggaatttatatcatgagcataaagaccacccccagttctcccactcccctccctcattttttgaagaagtctcccaccagatgggctgtggcatttgcagggattggctgactagagacattgtcccaagtaaggaagaagtttcctctgcctgatacattcagcacctaaaaaagtcaagacagacaagactaaatgatggtgctaattaagccagagagacaatctaagaacacaggacattcctcctcaacttgctatttcctttttattataattttaacttttcaatgctttaacattcagaaatctctgaggaacacagcatcattgcctaatgagaacttttgttggactaacagagatgtcagtcttcctatttatctgtgccccttgattgagagtatgagatgtaacagttgccattgaatgctgcactttcagcccctctcaccaattgctttctcccaagggtagcccagcaggcagaagcagctccatggcatgcaccctctcttggaggcttatgcagtctctgctttgcttccaacacatcaacacattccctgtagggcacattatagttttgctactgagtaagttctatgcagcttttttttttttagatggagtttcactctgtcaccaggctggaatgctgtggcgtgatgccggctcactgcaacctccgactccctggttcaagcaattctcctgcctcagcctcccaagtagctgtgattacaggcacatgccaccatgcccagctaatttttgtatttttagtagagatggggtttcatcatgttggccaggatggtctcgatcacttgaccttgtgatcagcccgccttggcctcccaaagtgctgggattacatgcgtgagccaccacacctggccagcttttaatctcttaaatcaattgttactttctactttgttctatggttatttgtgcacatgttttacttttagactgtaagctttagagggcagagttcatattgatttgtctttgtacaccaaaaagtgaacaacaaaaactataacacataaaaactcttcaaagaaaatatggggcacagctgagagacccaaaggacatgaccttttcaaagtagacttagaaaacacaggctatagggaaataggacctcaatcagtcaaaaattatggaatttaatgtgtatatgctcacatgcatgcacgcatacatgtcgggcgtgtgtttagaggaccttgtctcttttctgggaaataagtttctaaaagaagacttgcttggaacttaaattcctaaaactaactcaatgagtaagataatctcaggaataagacatcacatttttgtaaacatcttcacaatgctgttaaagagatatcctatttctttgacagcaaggttataatgacccctcaggtcgccagactcccagtcagtgctcctgctacatgggactttattccttccagagttcagctccatgggactggaaagagacacagacctgtacttctggaagcctctgggctcggactcggatctggtgcttctcccgtaggtaagtggtgaccacatcaggattcagccaggtgttgtgaatctggacaccaatcctcatccccctgcttggggctatcccatgatgctctgcttccaggtagtacatggctccacccaacagctccaacttgggagtcttctgctgccaggtcccttcatccctattctgctcccaggagtcaaaccagtcagcagtgccgacgctgatggaggccactttcacctatgcccaaataagcatatcatgatcaatactatgcagcttccaggcatctctttctcaaacactaagtgtctgaactgctactatcaagagagttttgaactggtctgcctttttaacatattaacccagttacctcagccctgtggttatttatgcttctccagctctctatctatctatctatctatctatctatctatctatctcttacaattgagtagtactcaaatgagaatagatgggccatgttcagagaaggaacaaccaacctaaaccctaggattacatgacactatggagaaggtagtattaagcccttcagagacctcgaatgacttgatcacatcaaaatctatgacatttctccaataaactagcaaatcaatttcagacatacatagtaataatttgaggaaaatattgtgattctttgtcaatagcataagtgcattttggctgctgttaaaggcatcttttcttatccttcaatgttgttgaggaattcctacatacagctgcctacatctccacccaaaattagtggaaaaggcacaagttttgtagtcaggtaaatttggggttgaatcctcaatgtgccttttgctatccaagtggattgggcacacaatctttcttttttttctttttctttttcttttttttttttttttttttttttgagacaaggtctcactctgttgcccagactggagtgcagtggcagccacgactgcccaaggctcaggtgatcctcctgcctcagcccctcaagtagttgggactataggcatgcgccaccatgcctggctaatttttgtatttttaatagagacagggttttatcatgttgcccaggctggtctcaaactcctgggctcaagtgatctgcctgcctcagcctcccaaagcactaggattacaggaatgagccaccacacctggcccacacaatctttccaagcctcaatttcttcatgtggaaaagatacatacatatatctttatgtatatatgtgtatatacacacaaacacatacataatatatatacatatatacatacatacatacattttgcagagatgcagtgaaaactagagacaaggtctataaaagatgtagcataatatttggcttacagtaaatgctcaataaatagtacgttcacattcaaacaagttctttttcaacaattaaagttcctgatcatccaatggcatgttaaactatctgtaaaacatgagagccttaactttgattctttctttcttcatgggtatgggactggcaacagagaaaaggaaaatgagaagacagtgaataccttagtccttggttcctctgaccaactgaaatgcaaggaagcttggctatctgcctgaatccagaaagtgtaattatttgtctctggagccacaaagaacccactgagccgtgctctgtaaagtagaacatagagtcaagcaagagtaaccaaggcctgaatcactgaaccaacaaatgactgcccttgtactttgtcttcttttatggtaataaagaagaacaacctgattcttatgccacacaattgtccagaatattctagaaagagatatagcacctgcctagtctcagtagcccaatacatctctacactggacacaaatacccttgctgttgtgtcatgtttgggaaagttgtagccacagcacacagctatacggaagcttagctgacaaaaccacctaacacagctattgcaagccctggatcatggtagaagctcaatctatagtaaatactattcttattattagaaataaagacagattgcttatgagaatttgctctgagcttaccagctacctcaacacctgcagagagcatttttctaattaaaaatattatgatccacagataagcgtcaattcaaaatgtcaacaatttcaaattaaaacccatcaaatgcaactttgaagaagattacaggcaatttcataaaacattttttaaaagataatatttttaatatttaaattccagcaacctaatattataggcagatatagttaaagaactgattagactctgtaaataaataccaagaatattttctgataatgctattttcttaaatcttcagatgatcaatataaagatgtttttaaattttgctttaatgtacatacattatctttatttttgagataatttcatacctaaaaatagcttcaaacataactactttaaaagtccacaatataattatattaacttaccaataaatgaatattttaattttttaatttaaaatttttagattttaaagagattaatgagagagggaatggaaaattagttactacctggcttgtggttcctcaaaatggcagttaaagggacataccctgcaacacttactatagaagtcaaaatgttcttttgccttttggggtaggctgactcactccttaacactcccaaatacaccaaatgcagctgaaagattttcctttgaacattattaaatggtcgttaaaaactatgataaatatgaattattaggtgctacaatggaccacaaattaactgccacatttttgtttatttgtttctttgtttaaagacagagtctcactctgttgcccaggctggagtgcagtggtgtgatcatggctcgctgcagccctaactcctgagctcaaacaattctccacttcagcctctcaagtagctacaggtgcacaccatcacacctggctaattttttattttttacgttttagagacagggcctagtcccaaactcctagactcaggcgatcctcctgtctcagcctcccaagtagatgggattacaggctcaagccatagcatccagccttaactgccactttaaaaccataaactcatggttaagtacctagtaagtaaggcttcaggagacactttcctgctcacagattaccaaccctacttggcttattcaatgcctaaaaattctctaagcttttctttacacaactgagttgaaatctattagattggtgcaaaagtaattgcggtttttgccattaccttcaacggtaaaaaccgcaattacttttgcaccaacctaataaaatggtaaaatatttggaggaggtcacagactgactgaaattcacactcatgagtcacagtcatcctctctaagaaggatttcaaagggaaaagagatccatcattcagtaaaggatccatccttcaacatatacactgagaacacactaaggaaacagtgtgtctaagcaattttcaagcttttatatttttaagtttactttagaatactagaaattttggctacatccttgaagggactaaaaagactaaaggaattacacaccattaaacaggaaaattagaatcatgatgccatcactactactgaaaacaatgtctcacagaacccgcaagagcttcccctactatacaagggccattgggttgaccttcagcactggaaggctgttcctacagcatgctgcctaggctttgctccctcatgtacccaaagggcaaattcttggatctttctttggcatcaaccagatgttagttttacctcttaaccaggtacctaaagcatgttttactctgctgtctttccagtctcctggcctgctcagctcaatgttctagttgataatcatctccaaaacagattgtaaactaagttgtggaaaatatacatattacatattgatcaaaatttgtccctgcactagcatgaccaacactgattgagaatactgtcaaactctgttgttgttgaattggctagtgttataaattcctggaaatcttgataccttccttatctgtctcctagcctcacctaggttagcaaaggtgcttttgatgtgggctcccacttttcctacaacatacctgaaaggttgtccttcctgtgaccaaaacccaaatggagaactggcattagggacaatctgccacctgtaccctggggtggcttcagtcagttccagtccctcaacagcatctccaacttcaaaaagaagccctcgattgcctgtaagacatgtagatcgcataaacattacagggcgcaccttcccaaattggggaattactttattttaaattacaaggtgaaagatgacccagatgctacctgtaaaggtaagtcaacctagagccagatagagtagttatatgaaaggttctgtagttaatatgaaatacaaatgttccggaaagtaataaacattccatgggttaggagttagccttttttagcaagagttcctagaaaagagaatcaagtcctggagaaaatgtgaattgaatgagcaaacagaagctgaggctgagtaaaaggaggacaatgtgactgtgtgctggtgacgtggcttggctttgtgcttcccaaagccagaagtgggcttcagtatcttttaagtcccagttctgctgtgaaattcaattctctaaagtcttttttccccataacattggcaatccttaagtttctcaagtgtcatggcctcaatttgtggacctgcacacagagccaaatatgtggcatgctgctattatgtgacattttaaatgatattgtattaatttatattttgtgttaagcaaaccctgaggccaaaggcacaggtgcaatcaatattgaatgctaacttgggctgaaggcaaaactctggaatcccagctagacgtgtagctttgagcaaattccttgatgtccttgcatcttcattttctcatgcatcaaaatgggaccaataataaaatagcaataatacactaggaccaagggaaaatatatactcaaagagcctggaatacagtaagtgctcaataaaggtaattatggtaattattattttaaactaatactgttgttcctcaacaactcctaaaagggagaggtggataaggaataaacagaaaagtaagagcatattttgaaaatattactttaaaccagggtttctccaccccagcactattgatattttaggctgggtaactgttgtgagggggtgtcctatgcattgcacaatgtctagcagccttcccagcctcagcccactagatgtcagtatcatcaccaccaccaccacttccggtctaacagccaaacatgtttctacacattgctacgtgtcccccgaggggcaacattgcccctggttgagaacaattggtttccatagtaattcgcccagcttctgtggaagaaacttcaaaagcccttcataaaggacaacactaactgtcaaaccagctgcattcaggaaattatcctaccactacccaagtagctaaagcaggaaatactgaaaaagggagcagactctctatttcctgacaggaaacacacattatcttgattacttgtttcagtagttttgtttccttggatggaagctttccctgagtaaaaactgcagatctgggagctggagaattctcaagccaaaactttgcatgcattttcacacctgaatgccctttctttagaaaggtttcttcccctgctgggcaactttccttgtaggtgctgtgcctctagagttgactctcgctgcctgtagtttaaccattaagtcaggcccttgggcacagatgtgcagcctgtggttcttggctgagtaacataccaactgcccttcatccctgactacacttgagccttcagttctaatgctcagcagaaaagtgctccagtattgtgctcttaatttgctgctgtagggtggatgctttaaacagagaaggacagctggaagctcccttgcctcctccatttctgcccacttcaggcataacctggtggcaacatcacaatatatccctgtttctcaaagcagcagacagatgcccacaagagagaaaaattcatatttaaatgcatcccattgtgccctactctccgaccttgtctaatgctgttgttttgagcatagcagagcacactctaacgctcctgtcttcttagccagtggacgtgcaactgacccattgaatgaaggcgggcagtttgggggtttcttccagtagctataacaatatcttgagggcagttatgctttctagaccatggtctcttctggacgccactggccatacagctggctggagctagaagtgcaatgtcactaagcacctgaataaagctaagagccttcctgaaaggagagccttgacaatggtatcatggacccagggctcactgagtaagccagtcaaatagatgagaaagaattcaaacacttttatttctactcgccagcccatcatgattaaagatattcagagtttattgaacagccctggtggcttccttacctggctgaggggtggtgagcctcacatcttttcctggagcccgagtggtgcactcaatcttcctgggagacacgtgtctaatatcacatggaatgcctaaagcgaattaaagaaatttatgtatgtgtgtgtgtgtaggtatacatatatatgtatatgtgtgtgggtatatgtataattatatatatatatatatatatatatatatatatatagagagagagagagagagagagagagagacagagagagagagaggcagtcgggagatgtgatggcaagaccagactgaagtagacaggctcctattctaaggcaaagggctgggtgtggatggaatagcgaaagttgtcaccccaattgaaggagaaaagagagagtgcagagcagcagagcatagggcagcgtggagtattcagaaggaaagccatgcaatggagtgctcttcattggggacgtactgaaccacctaactgagcatgggaggtaagtgtgacatgacagtgtgaggacacccttggtgtcaccaactacagaggcatcccacctgctacaggacctggcaaaacaaaaggctctagacaggtccataaaagggtttgccaaggttggggtgcgggggatttccagagtaatctgcatagcaaatgcccacccactcctgcttgtctatatcaagacagctaacaagggagagtgaagagaggggctgtttttagtagaagtaaacctttgtcaagaaggagctgtatttctttctttctcttcactcacaagataggggcacctgagggaattgcctatgcattgtgagtgtgtctgcaggacattccattcctgtgacccatgtactgtaggaccaaaatcccacctggtctcaaccaaacacatgacttatcaaacatgatgagtcagaaggggcaaagcttgcttcctcctgcatccctcatgccatacagacatataatctcctagagcatctaaaactatgaactattttcagccatttcatcatagttacctgcaatggtaacctgggcagaattgtcaaaaaagtctcctgtaattgtgatgtttgttcttcccccaaggctcccagtttctggaaacacagataatatttctgcaagagttaaaaaaaaaaaaaagtaagcttccaaatatagaccagaatatgacctagataataatataataataggagatattaataatttcttactttaactttctaagtccagcaacagttgaatttttttctagtaataactatttaaaaatgcacataataagaaaaagaccagaagtatatattatcgaggatcaatatttgaaaggaaggggaaatgtggaatcattcatggtatcagcaaaagcccctagtaccatgacattttctcagaaaatctgtctcctgacctcaaggacaatattgacaagtcagggaacagtaagttacaacacaaggaggaatcaactttgggtacactgggaaaggcttcagttcacccatatgaatctgtaatttgctctaagcagaagaatgaatttcactgtctttaggaccctcccactctttcccacactgaatgctccttccccacatgtacctcacacctcatacccagttctttcatgctgctcctgattgtttaaaattgcctacagtgactcaggcctgtaatcccagaactttgggaggccgaagcgagtggcaggtggatcacctgaggtcaggagtttgagaccaacatgaccaatatggtgaaaccctgtctcttctaaaaatacaaaaattagccgggttccgtggtgtgcacctgtaatcccagctgcttgggaggctgagacaggagaattgcttgaacccaggaggcggaggttgcactgagccaagatggtgccactgcactccagcctgcgtgacagagcgagaccctgtctcaagaaaaaataaaataaaaaatttaaaaaaagaaattacctacagtaatatgacacatagtcctcagaatttagctttatctcattctttcctctcctacgatcaagctttgacatttctaagattcattccctccagagaaaagaggagttgcattttgtgtaaactgaaggtacaaaagctaatgatgaatggttacccctgaaaaatagacattttaggaggttattttataatgctttttgcccatgagacaaagcagaggagacatatggaggcaaagattgatcccttacactcagataccaaaattcaccactaaaccataataaccccctgcttttaacccactattttataatttctttttttttacactagcactggaattttgtatcagctttacgtagagattaacacattcttttgttatgcattcaaaattacacagatcaaaaacaaaatttatgaagttcttaaacttttaacatagttgtagatatttgataatttttttcaacattcacagagcacctattatatggtactaggaatataaagatgaatacaaaatagttcctgtcctcgagaagatcagcatggtaaggcaggtatgcaaaactatcatttaataccttgggtcggagaaattagagagtatatgaaagaatagagaactttgggagtaggatgggagtattgaggtgtagaagaaaatgtttagagatgacactaatctgagtcttaaaggatgaattagaagtggcctagcgaagaggagaaggagagggcatttaaagcaaaagatagcctgagtgtggacagaagaaattgcacagtgcatgttaagtgtggctggagtatgagagacagagataaagctggagaaacagacaaggaggaggtcagaagtttgccccatttccagtaggggatagcaagccataagaggatggtgaataggaaggaaccatgcatcagatatatgcttgatgtagagaaagccagggaggggcttgaaggggcagagggcaagtcagggcctctagaaaccactgcagcatgtaacacaagaggtgatggggtccagaaatggagagttgctgtacagatacatcataaataagagagaaaactggcagaaattggtgattgaacagatatggaaaggaggaggaaggagaaattttagatgaattccaagattcttgctcctctacctctttagacgacttttggaataagaaggataagcaccactttgtcagttttagagatgcttaattaaggctcaaaaagcttaaaaggcttaactagtgattgaatgtcagcccctgaggagctcagcccagggctcttcatggctgtctacaccctctcttcctacagcctgctctgctgtgaagaagttctggcctgtgagtcctgatcccaagaagacactgccctggaaatgtaaaagagctgtgtcatcagagatacctgtcagcctatcagtcattctagggtttgatagcaatgggcaggctcacaaaaaccttggagtggagtggcaagaagagtgtgcttcccaccatatattggctatggacataagatttggaattagaactacacattctagctctaagacctttggctttggacaagatactttgtttatctgagtctgtttccttatctgtaaaatggggctaatgttaatccatctcatagttaagtgaaattaatattgagattgtatgtaagacacttaacaaggtctgacattctttctatagcagctatcgttatcaccatcaccttgggcgcttcttcaaacttaccccaaatagactagcaatactgttgaaagaaaggaaaaatcagggtcaaaatgcagctgttgcaggattaggctatctagagagtaaatgacattttctccatgacctgtgaattatcttgcacttttgacaaaggtagattttgattgcttctggaatctgaaccaaccccacagacatttcttcagtggctgtgtgactgtattccattctagaatctaagtattctttagtagccagctttctactaccaaatcgagttcacaattccaagcaagcttccaattttcacattcatttttttagtatgagggtttactcatcagatggcaacagaacagcttaatatcaatattagtcataaattattgaatgaatgctcagagatggatgttaaagtaactggaaagatgtgctttaagactttttaagtgccaccttttttcttttactttcagaagacagaataaggcaagactctcctttcttttattcagtttatatccatagaatttgtatagaagtttattatcaagtctcttttaatatattaactaaacctgacatggatacaagcaatttaatctcaaccaaaaacaccaggctgtctatgattgtagggacagcttcgggtgttaatggtcatcaagaaatggccaaaagatagggaaggaggggccaacattgagtgaggcacaagggaaggggtacttggtgaagggggatagtacctgagtgtgtctggtataggaaaagatcctgtttagcactgatcagccatgccttcttgtggaccattgaccttcgaaaaagacaaagttctgttttgaatgaaaatatcaactgggattgcattttttttagtcggctgcctgaaaggaagattgggaactaacctctattgatctttagaacagttgaaatagcagctcccttggataactaaagaacaataccaacaggacaaagttgttttctgatatataaaattatcatatgggaataatgcctgcttcataggatgtcccaaatgttcaatgaaatgatgagtgtgaaagggcctagtccttagttggcctatagtcaatactcaatagacattaattttatttcttccaaaatgagaaagagagaaaatctccatactttgggctgtatagctataattgtcactgtcattacaaggcaattattatcaattagaccctacgcttttaacagaaacacctgtcaaattatgtaggggcaaaatataaggtaaggattcagaattccagaatgctaatttatcacttcaaagtgtgataaaatgtggaccccttccattttcaagaaggcacttcctagatggtacaatgtatttcatgaaaccatgttccttataagatacttgtgacagttttcaacctacagtactttgaaattacttaagatttaattcccaaaattctgcaacaccaccatattgaaacacacattgcctacagattagtgaagaggacacaacttcattcacccaggtaaaaaagtcaaggagttatatgtggtctcattatactattctgtttttatatgtttaacattttccgtcataaaaagataaagaaagtaagcaagatgagagagataggtaatataaaatgaagacaaatttgcctatttctatacccagttacttactttcctttgttaaatactgagaagctaacattctgggagcctgtaacacaaagaaacacacattaactcaggaatctgcacgagtcttctgggccaggccattgctttcataagcccaaagactccaatatcatcaaattaccacccaaacctgtaatttctttagtggttcccccccgcaaaaacaaacaaacaaacaaaaaaacaaaaacaaaaaaaaaacacctcataagtttagcatcattagcaatgtggacttctagcaataaaagggcaaatgcagtattgcatagcagggaagagcccaggcttcgagttagatggagcaccatttaaatattgatttactggtaactaacttcaatttttctcacctgcaaagccaaaaataataccaccaacttcacaggtgtatgtgagcattaaattagtttctatatgagctgtttcatatagtagtattttccagggaattcttaacaaatagtaattattgttattattattatcctcatgagaaccaatcttgcaattgcttttgtccggatacagagaaagaaatggataagactttaaaattatgttacttctctaacagaccgatgtagtcgccttccacatggcactgcagagtcccaagaccatggtcctcctgaataggataactaaggaaaagacaaactgaggtaagaatgaccagacaactcactaccagaagatctgactctttaaccaggaaagtagaaagcaaaagaaaaccaaatttgctagagaaaatggtagacagagaaagtataatgagttcattagggcaaatgcttagggtaatactaactagtattaccctttatatatactagttagtaataccctaagcatttgccctagtgctaactagtactaccttaagcatttggtcctttcttttcaaatgtgtcatatgacaagtataacaaaacctttatttttaaaaaatctgttatcaagtatgaaccccataaaggacaattctgagcaaacaaaatgcagacacaaggaagactacacacaagggcagaatacacaccagtctgaaaaagtgaaaccatagagtatcattcttgtaatggcctcaaaggaggggcaacacaccctgtccagagtgaagtaaaaatccagcaaaacattgggtatttaaactggagagtgtagaaacttatttctaaattttttattatttttacctttggctagtcactgaagtatagtggttaagatcatgaactctaggggatgattagttagacagggttcaaatcccaggtctgccacttgctctctgtgagaccttgtgcaagttacttaacttttctgtgtctcaaattcctcatctataatgtgagactaataaccatacatactcccaagattattgggtgacttcaatgtaaagcattcgagcagagcttggcctatggtaagcccctaacaagtattagctatgtgttttcaaggaaggttttggcatccacttcaatacgcactttgaatcaatccctgtgtctttttcagtagtctaaagataaggtagtaaatagctatgtgtgatttatattttaaaaaaacagatatatggtgagtggggagagaaagagagagaatgtgtgtgtgttgtatccatgtggacgaacttacaagcatgtgcattggcaagataataagacactcaccagcttcccatctgcctatttataagagagcaaggagtaacccatttgtctccttgagcttccaagatcactgggctggatttaaaaaaaaatgaaaacaaaagacaagagataattgtgcaatactcccaataaacattcctcacaaaactcagaggaaacatggctatgaacactctcctctggatttttctgcactattgcaggtggctgaaggcggatgtcaagtcaaattctcagcagagagtagggatgcactcatggctcatgctttcacactaaacagaaaatagttctcccttcccaaaaaaccttcatcatctccacactggctatattgattctacacagagataatattgcatttatgcctttattccccctttcaaaggctgtatcccagaccaaggctgagatgggatcacctagcaaaatatggcacattcccaaggatgtagtaggagtttctaccccccacaagaagagtagttttcttgtaaggtaagttgaccattgcttaatgccagaaatgtcaatcctgagagtaataagatcatattctcttcaactagggcaaaatcagacagatggagtagaacagaagaggatgcccccaacccatccagagtgaaggaaaaattagacaccatgtatggaatctatgcagctgagtatatagtaagatcattttccttctaccttataaatgctcagtacaattgcttcatttgttgaatgattacagttgcttagagcttcctacagcctctacaatttcaacactttttgtcttgttctctctctccagtgtggatgatttaatagtaacactttccaccacgtctccagtgaagaaagtcatgttgacatcctaatcattcccagaaaacattaaaagctctatggcttttaatacctgtgtccatgttttcctctgaccccactaatacaatttttaaagcacaaatggataacaaccaaataagaaagttataatgggcttttgggtttacacatcattttataaagaatctatttcaggctgagaaacaaaggaaggaagggtgagaattcaaaaagaaaatccacagatgcaattacagttcatttcacactgagcccagagtgactagttgtcagtaaataaatggaccaacttaattgaccagttgcaattacattaacaaagtttgctgaagcccagctcatgagggaccataaactgcaaaaaggaaaatagcaattctgtgccaactgcttacaatttattgccatcagggaagctggtcccaggaagccatgcagcatgtatgtaactagttaaacacaaaaacaaacacacacttacctatcaatgtactcagcatcaaaatcaaaagtttccaatcttccagtgataatccagccatatacatgtattagttttcctgtttgaagaagaatttttttaatttaatggacttagctcaaactcaatgtataataaaaaaccatgtttctttttggttgtatatactcaatatggcaaagcaggtcatggcccagaaaattaatacttttaataaattgtacaacagtaaggtcaagggtatgatttagtgatcaatattacacaatataaaagctaaaataagcaattgtttcaatcacagacttaatcttctaatgcatggagcatagaaggaataatgggtcttcttcacagtctcagattgtgtgaacatttcagaaaggaggggctcatctccacacactgccctgttccattctcttggctctgtggagaccatctacccaacacgagatttaaggacaatgtgccttgggtgctccaggcttcatgagactttcctctgggcatttgctaaaatgaacatgtgatatgaagaggctcatatcacacaatctgatgggtcttcagggatcccaagtatgtgccttccaaataattagaatatttaaccatgtatacttaaaccatcacagacaatgtttagagataaaagaatgttggttagtgagataaacctcaaggaatagaagagaaaagcatactgagggactcatgaggtcatgaaatccagaagactgagcctctttatagacactgaatgccaccaaagaatgtgacaaaaaagatgttcccttcctactgcacttgtgtgttattagtaagaagtgactttcatctgcactcattggatgactctcactaaaacaacagaaatctttcggaaggtattacagccacaattttataggtgcatgggtagaatgacctaatgacaggcaaaggtcacagagttggcagaaatccagagtctcaagtttcctgttactgctaaaaaaaatctggcagaataattctaattttaatagggctaaatgatcgattccctagccttggtgagtatgacttctagctttgacaggcacaattttaaaactaacaaaagactgtagaaattaggaatttctgtgggtttttgttttgtttctaaacgaagatggccagcacaggctgacaaatggccacaccagagcacggtgatgggggattccatgtcgtagtgaaggactgctaaccacgtatagaaacccaactgctcagaaagcatcgtctctcttgtccctaccacctcccccatctccctggctgctacactgggcaggcttcccaaatgaaatgagagtattcatctggaaagtgattacaaagatgcagtcgtatggatcctgcccaggggggaccactccaacccagcccgccaccaatcctttccccagaaggtggaagagacaccgagcagaactccaacttggtggaagaaatgggcttggcagatctgggcgccagctgacattccatttcacacctctaatggctgtctgcttcctcatccctcaccctaacaagacttctgccatctacacaggagtttctaacatcagagcagcagggacccacatgtctgcatgtgattttcacagaccacatccctctttcataaaatatcaggtcccaatgattcagacaaatggaaaggagcagatctgtgaaaaacccacatgagcaagagcatgccaaattcatattctctgaaatataatttaaattcactcatacataatctgtgtctatacacacaaacacagaaaatataaaacgcttttcaataacttagatcttcattttgacatgcttgagcagttgagccaatcaaaacaacaagatccgtctatgcatttagacacaactataataaaaatttagcaactttttagcacactcttaccattttggaaactctaacaaatggaaaaccttaaataaaggtaggaatttggcaggaatcagacagcaaattatatataatcctagttgtgtttgctacttagttttaaggcagatttagcaattcctgaatccacttctcagttgcaatcccttcttttatgtaaatcccccagctttatataatcttcttttctatcctcctggcttttaaatatctgtgtgctctctaactttataaacaaaacccctagatgaagactagagttaatgaccttccaagtggcatccaatgctgctcaaaatatgacagaatggtggatatatgggccactctggattctggctgtctggttcaaatctcagctgtggtatttagtatctatatgactttcggcaaatttcttaaccttttgctacctcatttcttcaactgcaaaatgggaataaaaatagctcttctattatcaggttttggcgaggatctagtaagatatctgaagagcttagactggagcctggcacacagtttaataaaggtttattattatgggaatgattataaagttaaaagcaaggatgactcctctttcctccagtctccaacatcaactcatttgattttgctgtcctctttttcttttcatgtttggattccttttgttatcagtgaagtaatagagcaaaagtgcccagaggtaaaaccaaagcacgttaaaaatgaaccagaggttgactcttattttcaaaacagcatcaaagaagaagttaaattttcccactcataaaaaccactcacctaggtttgcaacaagctttggcaaacagattcacaattattcctattttaatagaagatttcttacctggaacaccacttggtggataaacttggtgaacgatgggtgtctgcgccttggaaaactgtttagaaaatagtaccacaagtgagcatgtcattaaaatattcacaaacacaggaggcacaagcctttcctcagacagcattacttgaaggtaataaatgcttatatttactcatgtcaccctcacatctgtctagttctttttatctttgtaatatttctatgaaacagaaatgatagatattatcatatttctcctatagatgaggtagaggtaatttgattaaggtcacatagccctctattctgtaccatattgtccaaaccttgacaagcctgtttctacctgcccaccttccatacccaagaacacattttactagaaggaaaggtagacaggtctttgtgcagaatgtcagtcttttaattccattgtaatttgatgttttggggccttgaagattttgatttttctagaaaggaatgcacttatttaattgaatcaaaacttcaaatcattatcagccagcaccttggtaggtatcagtaagctacaaaaaaatgagaaactggataggcacacaactgaggtgcttactagggaaactgaagatacctgctgtgagggaaatgactcaaaagattcaaggaatgggaagcaacattgttcttcaaggaggaggaaagcagcctcaatgggagcagtgagagcctgagaaagcctggcggtagcattccaaatcatcttacaatgccccctgtccccaaagcacaccctctgttaaccataagctccacaaaggcagggacaatgcttgactgagtcgctgctgtgtctctgtgcatagactggtatgcagacgacattcgaatttttgtgaatgaaaagagtcacccaatctgggatgactgatatactgcctggaaggagaggtgagaacgaggcaatcccaggaactccatctcacctgtaggcatctgtgttagtctaagattagtgcattactccatcaggaaatcacagcagggccagtatgaagaaacaggaaagcttaaggatgaactggccagaccaaggcttgacctgtgagccaattacttacctaggaagagacctagtctccccttccctcccctcccccaatcccttctagatgcctagactaccaccattccacacaacctacagtgcttcccatttgcaaaacaaattacagcagcaaattgttttgtttggtctgcttccagcacctcaggagtctaccttcccagagagaacatcaccaaagaataactcggttgttaatcaacagccttaatcagattgagaatcaacagacatttcaacaaagctgatggtggcttgccaggcgtaggttttaagtattgatccatatgctgtatagtctgccatgaaggctagtttcctcactgtctaaaggaaagggttagaaaatagttcacagaaaatatgtggtgtcagggggtcaaaataacaatgttgttacttcacagcttgggaactggctctgatctcaccaaaagataaagattaatacagttacacacacacctgccaaacattcagtccccaccccaccctcccagccaaccactgcccctaggccttcatatcaacattatttcaactggactatatcataggagcttagtgaagtacagtagtggttattgacctatttcacagatgtttagaacctgaggcagctggaacaactgagtccaaaccaaataaggaagcatacctctctatttcaacctgaaatctaagagccaccactcagtctataatccttctaccagacttccatgggaaacacagcaactcctttattactccctcccagctcgtgagatcgtggtggggcaggcttggggttaaacctcaaaaagggcttcacttgtgattctctctgagctgacacaacataacatggtacgtttctaagagaaacaggcccctggtcacccaccaggctagagacatgacaaagtgaaaaattaatgagcttccaaatcaagcttcccgcatgctgatcctcgggccccagtgtggtcagtagaagcaaaagaggggagaggaaatgcagcagattaggatgagaaagctgcagccaccagctgtgtgatcaaccttctgtgagttattcaaacttgtcagcgcccacagcaggctctttgcagtggactggcaagatgggattaatttttaatactcatggttccccagtcccagtcccaaaacaaagagacacgccgtgttttatttagcctggaatgcctctcattaactgcatcccctggtgatttttcatcaacttgccaagatagttgaaccactgacggacttgttttctttcatgtgcaattttaggaaacgtttctcttatttccccctctcgctcctaaccaatcttttaataagcaggaaaactaccatctggggtgaaaaggatcatggtgattaatgcttggacttctctcttctgttatgttccctgagacaggatagaggtggtggtgcagctcttagtaaaaaagaatgatataatgttttttctttctgctgcatatgtgcaaaagcaaaattccagaaaacaagattctcttggattaagaaacaagttattaaacctgaaacaacagcaaattccaaatttcaaaaccaaatagcctatatgaaacacggatcgtaggagagacaaatttacaaggtgaagccttattccgaaggagcattcattagtgactgcattgtatgttttgaaacagctcttaaacagaggtaccccatgtgaagggcaaccacatcgacaggagtaccgccaaatctctgcctttcataaaccatctaggaccttttcagagattgtttaaaactaatctgaaatgaacaacagactgaaccaaatataaatgaactcccagtataggtatcaaggctgtaaaataagtcaggcatggcttcctaaacactctctctctacttcctttttgatctccctgagcatgaaggagaattccagcagcaaatgcccttttggttcagtgttggaaagacttagcagaaatataccaggaagcagggagagaggtagaaattgggtctcctcaccaaggaacgtggggccttgagtctcttcaacatgctgagactcagcatgatctgagctgtaaaatgaaacacccacaaaagtaatcttggtggcccctctatgggcttctattttgatgagaatttagaaccagatgcaagttgaagtcttggttctgccatttactgcctgatgacatgggcaaattatttaatcaccctgagcctcagattgttcatttgtaaaaacaggacagtaaatagctaccccataaaattgtgagcattgaatcaaatgatgtacataaagcatttagctaaaggctgacatacaaacgttcaaaattcatctttcattagtataatataagaaactctgtcattaccatccaccattttcttttaacccggtcaagcagacacgctggctcatttacaatttgcctttcaataacacaagcacacccttagactatgtaaacataccttcctccagccttagaacccaccttgaaagtacagctatctcgtggtcctggatttggactgcttaccagctgtcccccgaagtatgcttccaggaagtacagaccctcatgtgcttcagacagcacagatctgaggacagaaagtggaaatccttatgaatcaaaaaccatgaattcccaaagctagcagcccacttgccacttcaaatttcctccttgcacttttaaaacagagctaaccaaggattcccagcagtcacctttcacctctttgatccactcataattattagactttaagaactgggtccttcagcaaaaaaaagttatgattttttgtgttgaaactccctgaattgtttttaatatgtcatgtttctcaaaatcataggttcattggactttaagaattagaagagactttgataatctattccccatttccatgtttcaaaaaatgtcagaaaaactaagagacttatgtgtatgagcttcaaacgttaagggcaaagtggggcttgaatttaggctctttctgataattgtccaagcagcccataaatacttcatgtagccatcaaaacagagtcttggatcttctctcctctttatacaaatattgcagtggcttcattgccacctgatgctgacatccatgttgatttttgtaagaggaagaatatgactaataagaaagaaaccatatttaagacatgcctcctctccaaaccttcccaacaaaatctttagtatgaccttaaatatttagatctgaattgtccattgtgttagccactagtcttatgtgcttatcaagcacttgatatgtgggtagtcccaattaagatatgccatgattataacatgcacactaaattttgaagacttggtatacaaaaaagatataaaagtatctcattattaatttatatagattacatattgaaataatattttagatatgttgagttaaataaaatacattattaaattaatttcacttgtttcttttgactttttcaagtggctaaatagaaaattttaaattacatttgtgttcacattatattttgattgtgaagtgctgcttttgatgctgcaatggctgttttagagaaaacaattatgtacatgtttttatgataatgatgaataagacatattttgttcatgaaaaactgtacatttttcacacttaattgaatctgatatttgtcttccaatcaattagtatatttaataggatcatatttcttttctttaaaaagatgacataaaatcaatggtgcatccaaaaatcattagtatgttgggataaaggagataggacatgtaaatctccagagctttgacttgtttcatggcaagtctttgcagaatgtctatgcccaaatgtgccataaaatctaagggaaatatataacccagttttaaaaccaatagtagtggtataaaaatgttaaattcaacagacatttattgaacatcctctactcgtaagatattgcgcaatgcatcatgaggactacaatggtgaaattaaacacatcccctgccctcaaagcacttaattctgtgaggaggagtctgacaagtgggtaactgacatataagtgttatgaaaactcagagctgaggcacagggtcactaaggctacacgtgctgtacctttgtgtaaattacaaaaaaaaaaaatcccttcggggtgatgaattgcacagaaaagtgtgggtacacacacatacaccctgtggatgaattactacaagttgttccttctcctttcaaaaaagggaaagataacttagttgaatgttcagggaaaaggtggcatttgtggtatggttggtgatttccatagccaaacatggaagagggggagacttcctcaaagagagaacagaaaagaaaaggaaataacagtgttttttttctcttaaccaatcatctacttgcatgcactttatttactcatgcctaagacatgagtaaataaaaatgaacatgaactagtctaaatttcacagggcaacaagaagttgagtagaaaaacagattccctggagtcttataaaaatattttctaaatagaggtaatgtcaaactcagcaaacagagcctaaagcaaatttcttttctaaccagtttggggtttatgtgcaatcattgcaattatgcctattccaaaagatgagtatttgcaatggcaaaatggtaccatttattaaaatcttaatagccatagaactctttgcaaaaaaaaacaaatggaaacacaatccagcccctccttacgaatatctcaaagttcttccccatactctcatcctccgttaagttctagaccccagatagggaccttttagaaagcatattcacatgaaactttttttaacaactatggctggcaattgaatcacagcaaaaattgctctaatatgtcaccaaaagatactgagataagcaaaaatccctcatcctgtctggtcttcctattcccagacaggtatacctggtccggcatgtcaccacaggcaaatccaagaaaacaggaaagacgtcacagggaacactccgcagtgcgggcaccaccatgttcacgttcaccaggtgtatctccaattgagagccattgttggggtaaagaacacccaactccaaacctaacacaagggaaagaaatctcaggctgcatagaattgtcattgacacaggacagtgtgaaactgtgctaagatcctgggggtaatgtaagacattaaatttgcccaaggattaaattaatactcctcatttcctcatagatgctgtataaaggagttttctcatttatgattttatgaaagagttttctctcttcaggttcacctaaatccagaaaagaatttttcagccctcagatttactctttactctgctggggatggatatgctaagcaatggtgcagaagctcccaagtagaggactgtctttaaggaagatagccaagattctgggagatgcattgctgagcactatgctacacacttccatatcatctcatgtagaaatcccagagtcccatcccacagcctggaatgggaaagtggacacagagttgtcatggtatgctgtgctttgcttctgtgacattagcaagccagtatctagaaagacagaagttggtcagtctgttcgtctcccttcaggcccacttttacacctgtccttagaaaaggaagaaaaccaaagactcatagtctttaggattgtgggtcaatacataagaaatgtgcacttggtaaaaccccaacctaccatcaaaaatgactgtgatccacgttccccctgcaaggctaccttcttcaggttcaatatgtaaactcaggtgacgtactgtaagtaagtgaaaaaaaacattggttttgaaggtcagattcaaaccactaccttctgcaatattttaagcaatatttaacctgcctcagaatcaccagaaaggcttgattaagcacaggtggttgcaccacatccccagagtttctggttccgtaggtctggggcaggcccaagaatctacatttctaaccaggtgctgctggtgtgggaaacacatcatcagaagccccattttaaggaaaattttgacaaattcttcttatcttagacattcaaaaaccctgcactcatcaggacaattctgaatttctacttcctttggaaagagcctcaaggacatatttgggtcctaatcaaacccatactgtctctctctgctctctttcccactctttaatcaggtggccatatttccctgtaaagatcatcaatcatttccagtcctggagagaaaaaaggacttccattaggttggtgcaaaagcaattgctgttttgcattccttttaatggcaaaaccgcgattacttttgcaccaacctaatagaagctgttcctatttcaattctcctgctcaatatactgcttaatatactagttttccctcatgatcagaatgacttcccaaatgaatacaaaattatctagattcttgccttgcctgcttagagagggggtgaagcatggatcattgctggaatttccttttgtttaaaaaaaaaaaaggcagtatagaatttatatactaggctagattggattctcctgtatagatcaccagctaagcatgggccttaatctatccctccatctttgaagatgttcctggacaagtcttgatgaaggaaaggccaagttaaggaagccagcaaaaatcatgcagctgctcagtgaggtaataaacaaggaaagtgttaccgacagaattatttatagtttctttagaagaaactgtgtctagcccaggacttccctgtacagttattctcatgatgcacttcacatctgaaggtggtggggaaccacgtcacattagcacaaccatttatggcagccccagccagactagaccatcttccaaagatgattagatacttctatctaaagaagccccaaaacaaaggccataaaaagatacagaggataaccaaattcgcagagaaaattgaacagatgatttgagataatacaagcaatctaatgattatgacaagttaatctctttgggaaagtccgacagcaaaatctaaaaagaattacatcacatagcccaaaaggaattataaaagaaaggttataagttattattaaaagctctgcactacaacaataatcttcactgaccattaaaaattgaagtatatagtcataacatttcagtatataacctcagctgttaaacagaaaataaaaacaattattcaacatataatttaaacccaaaagcaaataccttaacacctgctctgaaaacagtatttttaactcaattttttgattggcaagttaaaaatgcatatatttatggtatacaaccaaaatattactttaagtttcaataatagttctcaaggtaacctattgtgttcttacctataattccttcaaaacacattctactgacctgccaaaagtagtacttcaatactcatcagagagatcagccaggcagtcattctgtccacttaaatcaatactcttaagattgctcagacattaaaagcattttcagttttgattggagcagcatagcttttgtgctttataaaaacaaaaaaagcaaaaaaaaattatcattttgtttacatacgattattttgctgttctgaaacctgggaaattaaggagatgagataaacatggccttagtgtcttcaaatggagccaccatttttccaagctcaggagaaaaggatcatctgagaaccttgcataaaatcatccccactctgccctccttgtcccaccaacttattttaagctggataaataataacctctttcattaactcattattgaacagaagctgagttttaaaaagaattctagaaattaaaattctagttcgtgatagggtgaagtctgttttgctttgccctgtgctggcgtccagctttccctcgtgctgctctccagtttgaaccctacactgcagccacacgccgttctcaccgtcactcagacaagccttccacacatcagcctctgccttggcccctgctggtcccttcctggatgccctcaactctctccgtggcctcaggagatcctggcgcaccttcgtggtgctgctcaggagcccctcctcagctgattctttcctccgccattccagtgctcaccaccttccccctgaacctctaacttccgtgctgtagagcctagaccagataatgtggcacacataggcctcttcttccagacggcacgttccttgaagagacccaggaaccagtcttctatttccacagccttcctagtgtgaaagtgtgaaggtcccacacagcgctcagtacattggagtggatgaagacatatttgaataccctaaatctgggtttacctaatctgagatgaacagctttcactctcatgcctgctctaaggaaagtgctgagctgctctccagcacctcatggcagagggcatcgacaaaatcctcttaaaaatagtgcctctgaaattttctgaaagtttgaaaattacagaattaaacacccacatgtactactaaatacacgtttaatatatatttaattatgtttatgtttattacatataaatatataaatatatttaatatatatatacatacctacatacacacacacacatacacacacacaaagtgtgtgtgtatgtgtgtgtgtgtggcagggtctcattctgtcatttgggctggagtgcagtggcatgatgtcagttcactgcaacctccatctcccaggttcaagtgattcttatgcctcagcctcctgagtagctgggattacaggtgtgcgccaccacacccggctaatttttgaattttttgtagagacaggttttcaccatgatagccagactggtcttgaactcctggcctcaagtgatctccctgcctcagcctcccaaagtgctgggattacaggcatgaaccaccacacctggccatttaatttatatttttaagaaaacactgagattagcagaagtagttacatcatttctgaaaatataaaagctacaatatactccccccctcaaaaaaaaaatctgcaaaaactttgcaataaactcaccttacgggcatgttctgattgagacagctggaaatctataatcatttctatttaattcaacactgcaaacatttattgtatgcccactacgtgctaagcactatactaaaagttgggaaaacaaacaatctatgtacctgcccccgagtcattaccagatagggtaagtgtggaggctacttggatttaagaaaggaattctagtattttcaagtggattcagcaagtgttccttttcgttgcaaaattcccaaacttttacgtctatttgaaatagaattcaacttataaatatacaactttcagaatacatctaccacatagggaaaagtacccaagcgtatttgctgcttagtccaaaagcatgagatctgacttgcttgttacacagacaaaatatactcagcacaggagagtctattttcaatctggctacgtgattttaacatttcttcttaatgcctactcccaagctcagaacaatagaaataaacattcgcacactggttttcttaaaaccctacatttggaactgcatctttttcatgtcaattataaatgtaattttttattagtctatccactaattcttcctaaaaataaactcagactctctttatttctcataactaaaatttttcaaccacagaggagagctgtgtgcatttatttagtcatgtttttgttctcctctctctctctcctctctctgctctcactccctcttcccttcttcctcccttccctctcagcttctcctttgggacatcgagggacaaagttgcaaggcactactatagatctcccatttcttccttttgttcaccagaacgttaacaagagatacaacacctagaaaacagagagcagagacttttctggatcaaacagtaccttttttttctgtttctgtctccttgtgactcaagggagaaatgatcctttctttctaagtgatcttatttctctctgtcaagaatccgtggacatgttatctggttagagctcagcctgcagccaccacgcaggtaactcactcacgttagactataactcacctaactcgtttgtgtcccagccaaatgt

SEQ ID NO: 241 - DNA, 60636 bp, Homo sapiens
  source 1..60636: mol_type = genomic DNA
tcaattcacaaaggtttattttgatgatttataaaagaaacattgccatagcaatttaaagctatttacaaatttaaaaataaatgtacataaatgtattcacatcacattaaacagttttaaaatattacacgtagtgttgaacacaaaacataaactaagttttaagccacataggtgttctgaaagcatgctcaacaaccacagccactggaggatggtccactggaaaaatatgatttcaggaaccagaagtaaagatgattaccctagtctcaggtgatgtggcctttaaaagtcactttaactttaaactgcaacacaaacttagatgaagacagactgaacaaacagtgagaattaattaaaaaaaaaattctcgtgtagcttaaaaacatagaacaggctgggcacagtggctcatgcctgtagtctcaacactttgtgaggccgagacaggaggatcgcttgaagccaggagttcaaaaccagcctgggcgacaaaacgagaccccatctctacaaaatacaaacgaacaaaacacagcacatagaaatttatactgtgatccatgtgagagtagatttaaaccaggatgatcttatttgtgattgactgggcatcgcacttttctttctttattctttttttttttttgagttggagtctcgctccatcgcccaggctggagtgcagtggcgtgatcttggttcactgcaacttccacctcccaggttcaagtgattctcctacctcagcctcctgagtatctgggattacaggcgcccgtcaccacgcccagctaattttttgtatttttagtagagatggggtttcaccatgctggccaggctggtctcgaactcctgatctcatgattcgcccacctcagccccccaaagtgctgggattacaggcatgagccaccgtgcccggccgcttcgcatttttcttttgcaggttgcatgccagccaatattcctctgtgctgggaagggaaagtttgaggatgtatcaagaccatagcagtggatctcactgctcttgcctactcagggctttatctacacattgatagcccctcagaggaaaggcaccagccgaagagtcgacactggctctgggcttggatgctgcctctgataaacgctgggcactctgaccctgaagccagggagggagtgcttggcagctgcctgggcacactcccctcagtccagttgccaggcgaaattatacagtggatggcagctccacagagatgctaaagtttgaggtctaagtgtcagagagagctgacaatttttatgaggaaagtgaacaacaacaggtgtttatcagtacctgagaattatcatctagtttaattaagcaaaggtatcaggaggtctgtttcagctcattccctttagtatggccctaaaaaatcaacagaactgtcctacttcatgttgcccgactagcaggcaggtatgtgaacctaaagtagaagtcctagcttacatattattcataattaaacacagttcattttattattctggcaactagtgatatttcatgattataggccttaaaaatctaatacaagtacaattaaaaaaagacatagaatgcttacacaatacagaaggcactttgaggttacatgataaataaaaatacattaatagaggcaggattatttattggttccttcagtgtctgtgtccatggtgatcattgagagcccagttttgtacttcacctttggcgaatagtgtaaagaaaatggcaccaaaaacattaatagcagcagcaatatagaacacggtttgccattctccaacagtgttctataaaggaagacaaaaaatgcaagtgaaataaaattttgtgtgtagttcacttcattaaaaagatagtgtcacaagagtgttaaaacagccacattattcataaaagcctcatccttgaaacaacccaaatgtccaccagcagtaggatagtggtatatttgttcaacgtaatacaatacagcaatgagaatgggctacaacatcataaatacagctcacaaacaaaatatgaagcaaaagaagccagacaaaaaaggtacatactaaattattccatttatataaagcccaaagtcagaccatactaatctatggggttaaaagttgggagagtggttccacttggtgagggtgaaggaaaaataggaggaaatggtacctggggtcttactgagggaggtaatattctgtttcttgattgggtgctggttacacagatgtattaactttgtggaaattcatctagctgcacactttagattagtgcatttatttatttttgtttttatttttgagacagagtctcactctgtcacccgggctggagtgcagtggcgcaatctcggctcactgcagcctccactttctgggctgaggcaatcctcccaactcagccttccaaggagctgggattagaggtgcatgctaccatgcctggctaattttctttgtgtgtgtatatatatgtatatatatacgtatatatatacatatacatatatatatatatacgtatatatatacatatacatatatatatatatttttggtagagatggggtttcgccatgtttcccaggctggtcttgaactcctgggctcaagtgatccactcgcctcagcctcccgcagtgatggtactacaggtgtgagccaccacgcctggcctggatttgtgcatttaaaaaaagttatacttcaataaaaagtttactgaagatagatagatatacttcaataaaaagtgtactggcatgtccctgaatcatgcctaacactaactaacactaagaaagtcttatgcctgtgcacggtctcctgggttctcaggtgaaaggtgtcaggtggatcaagtaaatactgttaagatgaactcaagttcagctttgaggatctgtgacatcagagagaggcctggcaagtataaaagatcttgaatggcatacaaagcaggatataacatgggatctgtcagtaagacaactgttcagtgtataaccctgtggcataaaaatatcagacagttatctaaatttctgggtcatgtgactacctttaacaaccattttttggattttttcaatttcagtctaaccagagtggtgactacatttgcagcattaactaagaaacacacggccgggcgtggtggatcacgcctgtaatcccagcactttgggaggccgaggcgggcggatcatgaggtcaggagatcgagaccatcctggctaacatggtgaaaccccgtctttactaaaaaaataaaaaattagccgggcgtggtggctggtgcctgtagtcccagctactcgggaggctgaggcaggagaatggcgtgaacctgggaggtggagcttgcagtgaggctgagatcgctccactgcactccagcttgggcaacagagcaagactccctctcaaaaacaaaacaaaacaaaactggttgggcgtggtggctcatgcttgtaatcccagcactttgggaggctgaggtgggtggatcacccgaggtcaggagttcaagaccagcctggccaacatggcgagaccctgtccctactaaaaatacaaaaattagctgggcgtggtggcaggctcctgtaatcccagctactcgggaggctgaggcaggagaattgcttgaacctgggaggcggaggttgcagtgagctgagatcatgccattgcactccagcctggggaacaagagtgaaactccgtctcaaaaataaataaataaataaaccaggccaggcgtggtggcttacgcctgtaatcctagcactttgggaggccatggtgggcggatcacgaggtcaggagatggagactgtcctggctaacaaggtgaaaccccgtctctactaaaaagacaaaaaattagccaggcgtggtggtgggcacctgtaatcccagctacttgggaggctgaggcaggagaatggcgtgaacccgggaggcggagtttgcagtgagccaagatcgtgccactgcactccagcctgggcaacagagtgagactccgtctcaaaaacaaaacaaaacaaaacaaaaaaaaccaagcaggccaggcatggcggctcatgcctgtaatcccagcactttgggaggccgaggtaggtggctaccttgagccctggagtttgagaccagcctgggcaaggtggtgaaaccccatctttacaagaagtaggaaaattagctggacatggtagtgtacatctgtagtcccagctacttggggggctgaggtaggaagatcacctgagcctggggaggttgaggctgcagtgagccatgattgcgccactgcactctagcctgggcgatggagaccctgtctcaaaaaacaaagaaacaaacaaacaaacaaaaaacccaaacaaacaagcagtagaactagcaatgaggaagtgaaagagaaggcactgggaagccagtatgaggtcatttatttgggaaaaaaggagaaacatgaagaaagaaacaccctgtggtggctatacttgtctgagatgagtgcattttaatgaaaaaaaatcttagatactcatcttaaattctgctgaggaatcagtcaataattacatcttataccagaaagaaatgtttgaaacagcttcttaggattactaagacaaagctgccctgtgtggtctctgggacaaaataatacttcagtgttatctgaaggcaatgagtgaacttaaaatcaatcgttgtactacaagtctcacacagctcctagtttgttttttaacaaaaattccaccagtttttagagaatactgttttgtttataacaacattgaacctcagacacactttgaattttaattattgcattatttatttatatgctgactcattccacaaagtttttgaggcagtgctcaaagtaagaaattacaggctgggcgcggtggctcatgcctgatatcccagcactttgggaggctgaggcgggtggatcatttgaggtcagaagttcgagaccagcctggccaacatggtgaaaccccatctgtactaaaaattcaaaaattagccgggtgtggtggcacgtgcctgtagtcctagctacttgggaggctgaggcaggagaattgtttgaacctgggaggcggaggttgcagtgagctgagatcacgccactgccctccaacctgggggacgagtgagacttcatctcaaaaagaagaaagaaattacaattgtgaaggtaagtgtgtgcttttcctttttaaaaataatatactttagagttttatttggccgggtgcagtggctcactcctgtaatcccagcactttgggaggccgagatgggcggatcacctgagttccaaaccagcctgaccaacatggagaagctccgtctctattaaaaatacaaaattagctgggcgtggtggcacatgcctgtaatcccagctattcgggaggctgaggcaggaaaatcgccggaacccgggaggcaaaggttgtggtgagctgagattgcgccattgtactccagcctgggcaacaagagcgaaactccgtctcaaaaaaaaaaaccaaaaaacacacacacacacaaacaaaaaacaaaaattagcagggcatggtggtgagtgcctgtagttccagctacctgggaggctgaggcaggagaatcgcttgaacttgggaggcagaggttgcagtgagctgagactgcaccactgtactccagactgggcaacggagtgcgaaacttattttattttgtttatttttttatttttattttttatttattttatttttttgagacagggtctcccgctctcacccaggctggagtgcagaggcatgatcatagctcactgcagcctcaaaaccctgggcttatgcatccacctgcctcagcctcctaagtagctgggactacaggtacaaaccacacccagctaaaacagtgatatccttttaatagcattaaacaaatgctgtaacatatcccaaatcaagcgcagttcccacttgtaaacatacaagactgtaattcaggaatccatatttccctagcagaagtgctggcattatcagtaagtgaaatgaacacatggtagtgagctgacttaggttctggtgttgccaccctgctccatgaggacaaggttaaacattttggacatgtccatattgagacacagaactttagaaaaagcatttctacaacattcctttttattaagtgagaggaaatagtaacaggtaccgtgtcacttaaggaattagaaatggtagatgtggagaagaagtaggaacactatctgtcggatatatgtctgaaatcagtatatttggtaataagaaagtctgtaagtatgtcctgaaattctttttttttttttgagacggagtcttgctctgttgccagactggagtgcagtggtgatgttggcttactgcaacctccgcctcctgggtttgagcgattcttgtgcctcagcctcctgagtagctgggactacaggcacctgccaccacaccggctaatttttgtatttttagtagagacggggtttcaccatgttggtgaggctggtattgaactcctgacctcgtgatccacctgcctcggcctcccaaagtgctgggattacaggcatgagccactgcacccggccaatatcacaacttttaactacttgtgtggtttcagctacagtgtcttcatttgacttagttcaattgttttgtctaaaatccaaaaactgttctttgaaaatatactttcccatccattaaggcatttagctttttgttgctaaaaagaatttcataagaacatttagaattttaaacttaattaaaatacactgaactttgacacagatgtgcagctccaaaacctttccagtttacaagtaaattatctacttacatcaggggtcagacttttagcaatgacgggcccaaccattcctggaatagtggcaaatgtatttgtgatgcccaggaggataccagcatacctgtagaaacattttcatagacgtttattattgtgatacacatttaaacagcttcattctttccttcttttttttttttttttttgagacagagtctcactctgtggcccaggcttgagggcagtgggatgatctcagctcactgcagcctctgcctcccgggttcaagcatgccttagcctcctgagtagcggggactacaggcatccaccatcatgctgggctagttttgtatttttagtagagccggtgtctcaccatgttggccaggctgctctcgagctcctgacctcaagtgatctgcctgcctcggcctcccaaagtgctgggatttcaagtatgagccacagcgcctggctgcttctttcaatagacagctattctgctccaggttgtgttcttgtgaaattttatgtctaaataaaatgtcttattgcaatgggattttatattcagctggtgaaaaacttgcatttcaatagttaagtagcattttaacattaacattaggcccggccgccaccccgtctgggaagtgaggagcgtctctgcctggccgcccatcgtctgggaagtgaggagaccctctgcctggatgcccagtctggaaagtgaggagcgtctctgcccggccgccatcccatctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgcctggccccgaccccgtctggaaggtgaggagcgtctctgcccagccgccccgtctgagaagtgaggagcccctccgcccggcagccgccccgtctgagaagtgaggagcccctctgcccggcagccaccccgtctgggaagtgaggagcgtctccgcccggcagccgccccgtccgggagggaggtgggggggtcagccccgcgcccggccagccgccccgtccgggagggaggtgggggggtcagcaccccgcctggccagccgccccgtccgggagggaggtgggggggtcagccccccgcccggccagccaacccgtccgggaggtgaggggagcctctgcccggccgcccctactgggaagtgaggagccctgctgcccggccagccgccccgtccgggagggaggtgggggggggtcagccccccgcccagccagatgccccgtccaggagggaggtggggtggtcagccccccgcccggccagccgccccgtccgggaggtgaggggcgcctctgcccagccgcccctactgagaagtgaggagcccctctgcccggccagccgctccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggctgggatgacaatggcggttttgtggaatagaaaggggggaaaggtggggaaaagattgagaaatcggatggttgccgtgtctgtgtagaaagaagtagacatgggagacttttcattttgttctgtactaagatacattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaacgccgcagggtcctctgcctaggaaaaccagagacctttgttcacttgtttatctgccgaccttccctccactattgtcctatgaccctgccaaatccccctctgtgagaaacacccaagaatgatcaataaaaaaaataaaaattaacaacaacaacaacaacaaaaaacattaacattagaggaaggctgggcgcggtggctcacgcttgtaatcccagcactttgggaggccgaggcgggtggatcacgaggtcaggagatcgagaccatgctggctaacatggtgaaaccccgtctctaccaaaaatacaaaaaaattagccggccgtgatggcaggcgcctctagtcccagctactcgggaggctgaggcaggagaatggcgtgaacctgggaggcggagcttgcagtgagcagagatcgcgccactgcactccagcctggccgacagagcgagactccgtctcaaaaaaaaaaaaaaaaaaattacatacaggaacacagccatggaaataacccctttttatagtgatataggaaagttctgagatatcattttcatacagaaagcttagcatgtctagcttaaagttttttaagttaaaaaaaatttctttcctgatttgaaaattcaattgtaattaatttttgaaaattaatacgaaaaaagaaaaaaataatgaagtaaaattacctataattcttccccatagagatgatcaacattaacattttcataaatatcctatttttttctgtctgtatatatttctagtatgttattatagacgtgagatcatatcaaacataaaatttgcttgttccattaattacatttttttttttgagacggagtctctgtcgctcaggctggagtacagtggcgcgatctcagctcattgcaacctccgcctcctaggttcaagtgattcttctgcttcagcctcccaagtagctgggactatacacgcatgccatgtaggtcaggctggtcttgaactcctgatctcaggtgatccacctgcctcagcctcccaaattgccaaattgctgggattacaggcgtgagccactgcacctggcccgataattcatttttaaaattgctgcctctttttttttttttttttgagacagagtttcactcttgttgcccagactggagtgcaatggtgtgatcttggctcattacaacttccacctccccagttcaagtgattctccttcctcagcctcctgagtagctgggattacaggcatgcaccaccatacctgggtaattttgtatttttagtagaaacggggtttcaccacgttggttaggctggtctcaaactcctgacctcaggtgatccacctgccccagcctcccatagtgctgggattacaggagcgagccactgcgcctggcctaaaattgctgtccctttactaggatgtttgtcctgtatatattcatgaattctggactttgaagattgtatctcttaggtatcatttcacataatcttatacctcctgtatttcctgtacactgatagtttctagactctagatcctagggggttcattagatttaggtttaatgtttttggtaaaaaacaaaaacaaaaacaaaaaacaaaaaaaaaacacttaaaggagaaggaggagttcagttaaaaaaagtgctgcttaactaattcagttatgtataaagatcacaaagttttatgttcaaaacttgtgcatacacacagcactataacaaaaccatgaagtacagatctttttggctcatcccctttaggggtgtatctaaattaaccaagcttggcagagcctctcttttttttttttctttttaaaccattaacaccttggcagtaagaggagtcaactgcaatgttgccagcctttccagtgacagatattaagtgcagacgaatgccatgaaattctaaatgtcagcaacaagaagctcattcaagtacttatatttcacttggccaggacaggccatgaaagattgatgaccacttggaagaaaacaagttgtatggactcagtctggattctgtgctgttggagtactattggaattaatagctgaaaatctatctaattcccatgaattcgggcaacaaaattaccatagaaaaatctctattttggggccgggtgtggtggtgcatgcctgtaatcccagcattttgggaggctgaggtgggagaattgcttgagcccaggagtttgagactagcctgggcaacatggtgaaaccctctctctacaaaaactaaaaaaacacacaaaattagctgggtgtgttggctcaggctgtagacccgctcgctactcaggaggctgaggtggaggattgcaggaggattgcttgcgactgcagtgagccgtggtcttgctgctgtactccagcctgggtgacagggtgtgactctgcctcaaaagataataaatacattgataacataaaatctctatttcagtctatagaagtaaaggcctataaaatccaagtacacatttatatgttaataggaatattatttattggaaaaccttgtatctgtttactgactatgtattggaaaacctgatatcagacatgtttataagggttttatatatcatattatatcattttaattataaaatcaaccccatgaggaaggattatcttcattttatttttaaaattttaaaattttgttaagttttttagaggtacgatcttgctatattgcccaggcaggtcttgaactgctgggcccaaacgatcctcccaccttggccttccgaagtcctgggattacaggcgagagccactgcacccagctggattatcttcattttatagatgaagaaaaaccataaaatgtcacccaatttgtctgattctgaatcagtacttaatattataatgttataatctacaatgctaccttgttaaaaaaaacaaaacacagtaatcactgaacccaatctgtaggaaagataaattttctcatgcttcatttttcaccacaagccctggtgttgaacttgtttatggcttgtttatggtcctcaagtgcctctgttttaactagtagcgtattacactgaatgggccctcagttgttaccacaacaaaaagcaactatgaaaaacctaagatatgtaatccccaataagatatgtagccaagactcctgcaactagaaataactgatgtgctttgaatgaagaaattccagttggaaaagaaaaactaaaaagctcatctgaagagctgaatcaaaatataagaaagttatcctttgagctagaactgcaaggtttaaacacacacacacacacacacacacacacacacacacactaagggagataaataattttgactttgggctgggcatggtggctcacgcctgtaatcctagcactttgggaggttgaggctggcggatcacctgaggtcgggagttcgagaccagcatgaccaacatggagaaactccctctctactaaaaatacaaaattagcagggtgtggtggcacatgcctgtaatcccagctacttgggaggctgaggcaggagaatcacttgaacccaagaggcagaggttgcggtgagctgagattgcaccattgcactccagcctgggcaacaagagtgaaactccatctcaaaaacaaaacaaaacaaaaaacaaataataataattttgaatttgatgagatttatttatttatttatttatttaattttttgagactgagtctcactctgcagcccaggctggagtgcagtagcacaatctctgctcactgcaacctccaactcctgggttcaagcaattctcatgcctcagcctcctgagtcagtgggattatagtcgcccgccaccacacctggttaatttttgtatttttagtagagatggggtttcaccatgttggtcaggctggtctggagctcctaacctcaaacgatccaaccgcctcagcctcccaaagtgctgggattacaggcatgagccacctcaccgggcctacttacatttggaatagttgtgtctcagtcagctgagaaccagtacagcagtcctcattatctgaggcacaaaggcacttgcttaccatcctcccaactgctacaactatttgctggcatcatttatgttactaaacctgtttagcttcttatgatatctagataaatgtctttttcggcttataagactcataaaatttcagggttggacctgggtctttaagatgtagacttcaaccacccacctgatgcttgaagctcaggcacaggatccccctgctgcctgtccagcattatacttcatgacatgacccaccatcatccaggccagcttaagcttatacagatgccagcaggaatcatgttactttcatgtttgtgtcttcaacatctggtacagtgcctggcacagtgtttctcaaatgactagatccgttaatgagcatgctattacactgaaatttagtagtgacaaatttatctaattgtacatccaattcatctttctccaccttgtccaaaacggcatctatcataggaggcctggctgaagtcctgacatatcaaatctactatattttctttattctattaggctaaaaattatgttgagaagttagactgttttgccattttggctcttagtgacccaatggtggctctttagtggtcagcattttcctttctgaaagcacaccaatcatcactttaatattttacttggattgatctgtgaccctggtcaccacacctgactcaaagttagccagaaaataattacatctattgcattatatgcaaatacctttattgcattatgagcaaagtgttctgtgcgtgttctatttaatcttcacaacgatcttataaggtaggtaccatggatatttggttttctttttcttcagcatctattttcatcttttgacaatagcactattttttttttttttgagatggagtttcactcttgtcacccaggctagagtgcaattgctcactgcaacctccacctcccaggttcaagtgattttctgcctcatccttccaagtagctgggattacaggtcctaccaccccacctggctaattttatatttttagtagagacagagtttcaccatgttggccaggctggtcttgaactcctgacctcaggtgatctgcccaccttggtctcccaaagtgccgggattacaggcatgagccattacacccggccgaccatagctccaatttttatccgatgatccaattttctttcattgctagttcaagagagcagggggggccctcatcagattccagagattctaataagacttcaggaacctgatgaatcctaagctacctttcagatttattaaatggtgtgggtgacttaccaccttctggctggatggctgctgaaccaattttatgttccttataatttttttttttttttttttgagatggagtctcactttgtcacccaggctggagcacagtggcacaatcttggctcacagcaacctctgcctcccgggttcaagcgattctcctgcctcagcctcctgagaagctgagactacaggtgtgtgccatcacaccctgctaatttttgtatttttagtagagatggggtttcaccatgttggccaggctgatctcgaactcctgacctcaggtgatccacccgcctcagcctcccaaagtgttgggattacaggcgtgaactaccgtgcccggctcaaaatgactcatgtttatttacatcttcatgtgttataatggatgttaccgatggattcctcagcatccattcccactccccacccccatctgtgtagcaatagtgatgtctgaggggcactgaccctttgacttctaacttttggggtaggtgctgattgtcctaaagtcacatgatattctcttggccattggggttggttcatgtgactcagtttgggtcaaccaaaatgaagcccaggacttatttccatggtggagagaggaaaagatccttttctttctgcttgatgtgaatgaagaagcatgtagtcctgattgttgctggcaatcatttcattgtgtgattttataagcagacccagtcttaggacaaaactactactgtaaaagacagagagtgagaaagaaacaatctgtggtgatattagtaggcagctggatatcaactcttgcctgaagcctattatttctggatacaattaagtgaatcaatagattatgctgtttagcccagtttaaattagaatttctatacttcaactaaaaacatcctaagcgataacatagcctagaactatttcttgccaaaactctcaattcccatatccctttgactattcgtcaatcctaggcttgacaaaacctcaagtcttggccaggtgctgtggcccacgcctgtaatcctagcacttcggggggctgaggcgggaagattacttgaggccaggagactgagaccaccctgggcaagatagggagaccccatctctacaaaatattttttgaaaaattaaccaggcatggtgatgtatgcctgcagtcccagcgactcaggaggctgagcaggaaggattacttgatcccaggagttcaaggccacagtgaactacagtggcgtcactgcactctagcctgggtgacagagtgcagcttatcttagagtatttattgaagagataggagactgaggattcatagaaatcagaagattctgtaggagtccaggtgtgaagattttgaggtagtgaaaagagggtaagagtccatctgtcttttctccaaaataaatttatatctattatttttacaaataaagtgtattaaaacttttgggttaaaatatttacatagctcccttatttaccttgtcagctggcacaaaatggttttagaagtatgtggctcaaagaatatttccagagaggtagctgtagaaagaattttgggcttaaaagtaaaaattttaggttcaagttttggctctatcatttattatattagctgtgtgctgcaagataaatcacttaacttctcttaagtttctttagcgttcaaatagggcaaaaatacttacttcaaaggaatgctttaagggtaaaatggatagtgtttatgaaagtgatgtgtaaactatcaagggctacacaaatatatttgcacataggtaatatagttagacaaatcaattgggtctactctttcacattcattcatctgacaaaatgcctactacatgccaagtgccatggagagccctgaggacaataagggagtttctgccttcacagagttcctagtctagttgggtgaacagacacagtaatgagttattgcaatgttctaatgagagcactgtggacagaggtgatgatagttaaaagtttaaatttaaaaacaacttcctgctttaattattgtgtaaattaaaatcctgttaagaatttaaagtcattcctatagtagtcaaatccatagaggcagaaagtagaatgttggttgccagggcctgggaggaaggagaaatgggagattgtgtttaacgggtacagtttctgttgagaagatgaaattgctctagagattgttggtggtgctagttatgaaacaatgtgaatacttaatgccacagaactgcatacttaaaatggtaagttttatatcatatctattttatcaggtttttttttttttagatggagtcttgctcttgttgcccaggctgaagtgcaatgatgcgatctcagctcactgcaacctctgcctcctgggttcaagcgattctcctgcctcagcctcctaagtagctgggattacaggtgcccgccatcatgcctggctaatttttgtatttttagtagagatagggcttcgccatgttggccaggctggtctcaaactcctgacctcaggttatctgcctgccttggcctcccaaagtgctgggattacaggtgtgagtcaccgcctctggccttttatcaggatttttaaaaatataatttaaagtcaatcacagcaaatctttatattagtactcacgaaggagcaatatccagatggttgatgctaaatccagaagagcaaaagcctcccagtgttgttgatatagttaggaaagcaacggccaaagaataatcacagccaatgaagccagcagctaccaggaatactgcaggtccaatcattcctggagttaaaaagttataaaagggaaaaaacacccagcattaatatttgctctaccttaatatggtataaatctgaaatttgaaattgctgccacctactgtagaaacactatattgcctggaagactaacaaatttcatgagaaaaaaaaaatgctggaaaacatgggcgtaatacaactaatatactataaaaggaaaatctcattatgcaatgttattaaatctacatgtggccaaaactcagctaaaattccatggtgttagagaagaacaagacaagaacaacttaaaaatatgtttctagagagaagcaatagctgacacagaatgtggtttaaaatacatataaccaaaggagataaactgaataataaactctgttggatgaggttagaataatactccatcttgcctgggtgtggcagctcacacctgtaatcccagcacgttaggaggctgaggcgggagaatcacttgaggccaggagtttgaggccagcctgggcaacacagcaagaccctgtctctacgaaatattaaaaacaaaattcgccaggcatggtggtgcacacctgtagtcctggctgctcaggaggctgaggtgggaggattgcttgagcccagaagttcaaggttacagtgagctatgatggcaccactgcactccagcctgggttgtcagagcaagaccttgtttcttaaaaagattttttaaaatctctgtcttcattctctctctcttttttttgagctggagtctcactctgtcacccaggctggagtgcagtggcgtgatctgggctcactgccacctctgcctcctaggttcaagtgattctcctgcctcagcctcctgaatagctggaattacaggcctgggccaccatacccagctaatttttgtatttttagtagagatggggtttcgccatgttggccaggccgttctcgaactcctgacctcaagcgatccacccaccttgcctcccaaagtgctgggattacaggtgtgagccaccatgcccggccttggttttttttttttctgccccacctaatatgcaggaatcctccctattattaacaactgataagaatacacattggtcattacaggcagttaagcgtaaaatatgagaagagacttaatgagtgggctgtcagtttttctgtgtctacagcagtgctatccaatagctctctgtgatgatggaaatgttgtatttgtatatactgcaactgaggaactttaaaaaaagttcaattacatttatttacttatttatttattttcttgtttttttgagacagggtctcactgtcgtcaggctggagtgcagtggtgcgatcatggctcactgcagccttgacttcccaggctcaagtgatcctctgccttggcttcctgagtagctgggactacaggtgcacgccaccatgtctgatttaatttaatttcattacttttatttatttattttgaaatagggtcgcattctgttacccaggctggagtgcagtggcacaatctgagctcactgcaacctctgcctcccaggtgtaagcaagtcttgtgcctcagcctcctgagtagctgggattaaaggcatgtgccaccatgcctggctaattttttttttttcactctttttgcccagactggagtgcagtggcgaaatcttggctcactgcaacctctgcctcccaggttcaagcaattctcctgcctcggcctcctgaatagctgggacagccacacaccaccacgccaagctaatctttgtattagagatggggtttcaccatgttggccagcctggttttgagctcctgacctcaagtatctgcctgcctccgcctctgcctcccaaagtgctgggattacaggcaacagccaccgagcccagccagggtctttttataatgtaattactgaagtatagtcactgagacttccagggtctctactggagacttttaaaaagttaaatgattgtcttagacagttttatttctacgtacatttttttctaactatttttagagatagggtattgctctgttgcctaggttggagtgcagtgttgtgatcatagctctctgcagcctcaaacaactaggctcaagagattttctcaccttagcctctggagtagctgggactacagatacataccatcatgcctaactgattagatagttttaaaagttacctttctaggccaggcacagtggctcacgcctgtaattccagcactttgaaaggctgaggtgggaggatcgcttgagcccaggaatttgtgactaacctgagcaacatggtaaaaccatgtctctacaaaaaatcaaaaataattagctgggtgctgtggcgtgacctgtagtcccagctgctcaggagactgaggtgggagaattacttgtgcctagaaggttgaggctgcagtgagccatggttgtccatcctggccaacggagcaagaccctgtctcaaaaaaaaaaaaaattacctttctgaaagcagagtctgaaacacatgattatttatgggttctttgagttctttgatttatagctccttatttgatataataatgctagtaaatatttttggattgaaacttaaaatgcattcacttagaaaagggatggaggcttaaaaatactttgattacatcttgtctaaagttgatataaaaatcttcattgcaaagtctgagctgaaagcacagtgatatataaaattgtgagggatgatgtttggcacagcaagccattttaaaaataattataagccatggtggagataaatcttttataaattttttttttttgagacaggatctcactctgttgcccaggctggagtgcagtggcgcgatttcagctcactgcaacctctgcctcctgggttcaagcaattctcctgcttcagcctcccaggtagctgggattacaggcacttgccaccacgcccagctaatttttgtatttttagtagacagggtttcaccatgttggtcagactggtcttgaactcctgaccttgtgatctgctcacctcagcctcccaaagtgctaggattacaggcataagccactgcgcccagtgaatattataaatcttaatcctcaaaatgtatgattcaaaaagaaacatattgtaaagaaatgcacttaaatgcatcatagtgttttgttatgtgaacaaaataaaagactaatattatcatttttattttgtcttgaactgttgtgatattgtgattttaaaaaatatggctgggggctgggtgtggtggctcacacctgtaatcctagcactttgggaggctgaagcagcaggattgctgaaggccaggagttcaaggccaatgtgggcaataaagcgagaccttgtcccattaaagaaagaaattaaacaaaatggctggggctgggtgtggtgcctcactcctgtagtcccagcactttgggaggccaaggcgggcagatgacttgagttcaggagttaaagaccagcctggacaacgtggtgaaaccccgtcttcagtaaaaattaaaaaattagctgggtatggtggtgtgtgcctgtagtcctagctactcaggaggctgaggtgggaggatcacctgaggctgaggaggttgaggctgcagtgagtcaagatcatgccaccacactccagcctgggctaagagtgagcccctgtctcaagaaaaaaaataagaaaagaaatatggccagtgtggtggctcatgtctgtaatcccaacattttgggatgctgaggcaggaagatcacttgaggccaggaattcaagaccagacggggcaacatagcaagaccccatttctattaaaaaattgttttaaaaaagaaatatatatttggtctctgcccccggttttttggcacacagctcctaaaacttttggaatttctggagtggtaacagtgtcttttgtatgctaatgagacaattggtggctgggggtccccatacagcttcaggatggtggctggattagaggtctgggacttttggcaccacccccaaactccagagaggggagaggggctgaaggttgagccagtcaccaatggccaatgatttaatcaatcatacacatttaacgaagtctccatacaaactcaaagggacagggtttggatgaacttttgcggtcggggttcttggagggtggtgttccaggagagggcatgaaaactccctacccggtcccacatatgttgccctatgcagcttttccatctggctgttcatctatatcctttgcaataccctttataataagtgggtaaacataaaataaagtgtttctctgagttctctgagatgctctagcagattaactgaacctgacaagacagtcatgggaaccctgatttatagccggtcagtcagaagcagaggtcacaagctgggacttgtgattggtatccgaagtaggggggcgatcttgtggaactgagccctcaacctataggatctgatgctaccgccagctggacagtgtcagaactgaattacaggatacctagctggtgtccgctgcagaactggttatgtgtaggcagaaatccccacaaacattttggtgattagagcgaggtgttctgtgttgagtattgtgttaactgtgtgtaaaagtgggaaacacactttgttttcctatctcctataactgtaaacatggtaaataactgtaaaccaaaacaaaacctgattgcttcacttacctataaggctaaaaattctgcgaacacataaagttgaaaaattccattttgcccttaaattgtcagcagcttgaccagacaggatcatacataaccaagagcctaaataaggcaatgaagataaaaacccattctggaaggaataagaagatacaggattaattacggtgagagaaaaaaacaaaacatacacattcatcacagccaatgaccaccacttgaaagcaaaggaaatgcatagcaatatgttgttaattttttaatataattacagtaaataagtctggctgtcagaaggattatagggttcagtccaaggcagtccctaagagtctgtctcagagggaaataagccttgccctagtcctgtctgcttcgggtaatcttgactgtttctctgggatctgggttgtgagagaagacaaaccttcctgttagcctatggattctccctactgaacattttcatcttccattctcactcatttatttaaaaaaaattttttttactataaaataaaatgcagatgcagaaaaccacataaacatagcttaatgaatcattctttttttttttttttttttttttgagatggagtcttactctgtcactcaggctggagtacaggggtgtgatctcgactcactgcaacctctgcctcctgggttcaagtgattctcctgcctcagcctcccgagtagctggggttacaggtgcctgctaccacacctggctaatttttgtatttttattagagacggagtttcaccgtcttggccaggctggtcttgaacttctgaccttgtgatccacccaccttggcctcccaaagtactgggattacaggcatgagccaccgcacccggcctcatgagtctttctaatgaccatctaggtcaagaaatagaactttgccagccttgccagaagacacttcatggtcctagtcctatcagagccctcttcctccccccttaaataagcattaacctcgttttggtgtatagtaatcatgtactcacttttatttatagttacatcacccaaatgtacatccctagacacttcgatttagtcttggccattaaaatttttttgatttgccttttatgtctctttaaatctgtaagttcccttccattcatttttttcttacaatttatctatttcttaaaatttatcggtgcccagtaaaacaataactcaaaagtgcattacatgtttatttactacacacacacacacacacacacacacacacacacgtttatttttaacagaactggagagtcttttttttttttttcttttgagacagagtcttgctctgttgcctaggctggagtgcagtggcgtgatcttggctcattgcaacctccaccttctgggttccagcaattctcctgcctcagcctcctgagtagctacgattgcaggcgtgtgtcaccacgcccggctaatttgtatttttagtagagacggagtttcgccatgttggccaggctaatctcgaactcctgacttcaagtgatctggccgcctcagcctcccaaagtgctgggattacagggatgagccaccgcgcctggcctctgagagtctttcctgatggtttcttttccctcatttttcgcgtccaatcatcaagcattgcctattctacttcccttaaacaaacaaacaaaaaaagcttggctgggcacagtggctcatgcctgtaatcccagcactttgggaggccgcggaggaagaatcacttgaggacggggctcaagaccagcctggtcaacatggcaaaaccctgtatctactaaaaatacaaaaaattagctgggcatcatgatacatgactgtaatcccagttacttgggaggctgaggcagaagaatcgcttgaacctgggaggtggaggttgcagtgaaccaagattgctctggtgcagtcagtccagcatgggtgacagagcaagactctgtctcagaaagaaaaaaaacaaaaaaaagaaaaaaaaacacaattccatttagacttctgcacggtgggatcacatctatcattatttgtggcaaaatcctgtataagaataaatggtttcaaaatattagtaggaaagtaaaaaagaataagctgtagtaaatcagataagtgaattttctgatcttgattttgtttcctggtgggataaggttgataattcctcacagttagtaatattgccacttcaagttgcaatgctaaaaactgccggctaggcacggtggctcatgcctgtaatcccagcactttgggaggccaaggcaggcagatcacctgaggtcagcagtttgagaccagcttggtgaacatggtgaaacctcatctctactaataatacaaaaattaggtgtggcggtggatgcctgtaatcccagctactagggaggccgaggcaggagaatcgcttgaacctgagaggcggaggttgcagtgagccaagattgcgccactgcgctccagcctgggcaacaacctaaatacactaaagtcttcagcatttatacattccacaggcaccttccacagttgttaagttttctcttcaaggataagatcccttgtattcatttatttaaaaaaattgattccaatttttttgcaggcgcattggctcacgtctgtaatcccagccctttgggaggccaaggcaaagggatcacttgaggtcaggagtttgagaccagcctggccaacatggtaaaaccctgtctctacaaaaataaaaaatttagccaggtgtggtggcacacacctgaaatctcaggtacttgggaggctgacagaggagaatcgcttgaacccgggaggtggaggttgcagtgagctgaggtcgtaccactgaactctagcctgggcaacagagcaagactcagtcttaaaataaaataaaatgaaataaaataaaataaaataaaataaaataaaataaaataaaataaaataaaataaaataaaatgagtttctggttgtgacgacctaccgacgagaacacacctcttgcaaaaaatttccttcatccctctccagaagaggagaagaggaaacacaagaagaaatgcctggtgcagagcactaattcctacttcatggatgtgaagtgcccaggacgctataaaatcatcacggtctttactcatgcacaaacagtagttttgtgtgttgggtgctctactgtcctctgccagcctacaggaggaaaagcaaggcttatggaaggatgttccttcaggaggaagcagcactaagagcactctgaatcaagatgagtggaaaaccatctctataaacacattttagataaaagatttaaaaaaatgagagatatgtgactcttgctttcacttgaatacttgcaggccatcgtagggttatttattttgtttttctgtacagacggagtcttgctctgtcacccaggctggagtgcagtggtgtgatcttggctcactgcaacttctgcctcccaggttcaaggaattctcctgcctcagtctcccgaggtgctgggattacaggcacgagctgccatgcctggctaacttcttttgtattttagtagagatgggatttcaccgtgttgctcaggctggtctcgaactcttgagcacaggcaatccgcccgcctcggcttcccaaagtgctaggtgcgtgagccactgcgcccggccactgtagggttattaaccagcctaatttcaatattgttgtgtctcagggaatagggaagctcaaggagaaggaaagagatggggtagtggctggttggcagagccgtcagaagacactcaacatttattaagtttgccatcttatatggggaaggattatggtgccccccaacaattacaacactaacttcaaagatcaagagccctgaagtgagcacatgctgttggaaaaatggtgctaacggatttgctccatgcagggttagcacaaatcttcaattcataaaaaatacaatatttgcagagtataataaagcaaagtgcaataaaaggaggcatgccacgcttctcaaagcaagcttattttgaacaaaggccatctgatggccaggcagggtggttcatgcctgtaatcccaacactttgggaggctgaggcaggaggatcatttgagctcaggagtatgaaaccaacctggacaataatgggaaaccccatctctactatttaaaaaaaacaaaaacaaaaacacctaggccatttcatgaatgtaacacattgattttcaagaaaaaaaatcaattaaaaaataggctatataattatagaattattttcaaactctattcacatttctttttattttacagaatgaaagaaggtcctatattcacatttcttttaattttaattaagataaacctttttgtctatgaaaatgcaagataaaagatccttgttttaaagtacacaacattaattactggccagctattgatattttatttcttccatatatagttcttcctggaaaatctcaaatagaaacatcagtgtagtaatctttaaatatactttataagtaaaataagatattttgttaatatgattttgagaatttgtttttttttttttttttttgagatggagtcttgctctgttgcccaggctggagtgcaatggcatggcctcagctcactgcaacctctgcctcctgggttccagtgattctcctgcttcagcctctcgagtagctaggactacaagtgcctgctaccatgcctggctaatttttatatttttagtagagatggggtttcacatgttggccaggctggccttgaactcctgacctcaagtgatccacccacctcggcctcccaaagtgctggtattacaggtgtgaaccactgggcccggctggatttgctatttttaatcttcctgtggatctcagttttaccccaaatgataattaccaaattaacctttcaatgcacagttgaatgcaattaatcactgtagtagtatattatttatttctttcttttttaaaaatcagccccactttatagttgaaatgtagtagtagattataatcaggctctgttaacagagaacttgggaaaaataagattgctcacaatgaatccatcccattatgttgccaaagcctagtttcaatttaacttctgtcagtgcaatttgtggaaatatttctatatagtgatcttgtttttcagaagtagacagaggagttcttcacagcttagctgcctgaagttttaaggtttggtccacatagccaggccaatgtttatggtatactttggaatgtgagtgactgaggattcactttaatagtttttaaagcaggtaagtccatgtagccagtgcagttgtgcagtcagccttgttagcattttttttttttttcctgggacagagtcttgttctgctgcccaggctggagtgcaggggcatgacctcagctcactgcaaccttcgcctcctgggttcaagagattctcgtgcctcagcctccctagtagctgggattacaggtgtaggccaccatgcccggttaatttttttgtgtgtttttagtagagacggttttgctgtattatccaatctgtattatcgaactcctgggctcaagcagtccttctgcctcagcctcccaaagtgctgggattaattattattattattattttttgagatggagtttcactcttgttgcccaggctggagtgcaatggcttgatcctgggtcaccacaatttccgcttcccgggttcaagcaattctcctgcctcaacctctcgagtagctgggattacaggcatgcactaccacgcctggttaattttgtatttttagtagagatgaggtttctccatatttgtcaggctggtctcaaactcctgacctcaggtgatccgcctgccttggcctcccaaagtgctgggattataggcgtgagcgaccgcgcctggccttttttgtatttttaacagagacagggtttcaccatgttgcccggtctggtctcaaatgcctggcctcaagtaatccacctgcctcgacctcccaaagtggtaggattgcaggcgtgagccactacacccggcctgatgtcgggcatccttacatgtgcttattggccatctgtgtatctttggagaaatgtgtattcgtattcaagtcctttgcccattttaaaaactgagttgtctttttattattgaattgtaagaattcttaatatgtctggatactagacccttattagatgtttgatttataaatgctttctcccattcagtgggttgtttttcattttcttaatagtcctttgatgtataagaatctctaaaatttaggacagcagagtaaaatggaagatacagaataactgaattttatacagatgagaacaaattctgtgtatggtcttatactatatatataagaagcagatgattattttttcttacctcttgaacattgaaccttaggatctccttcatataagtaggcaataatgtcaataaagtataaaaagtccagttgtaagaaaagtgtgcaactacgatagcccaaagtggcagggattttaaaatgggtacccacggcactgacttctgtgaagaaagctgaagaaaacaggaataattaggataaactacggctatgttaatgcttagatctgtaccgtatcagctaaaactctatccagaattcatacagaatatcaccttaattagtaaactccaaatttttaaatcaactcctttgaaatattaaatagcaaaatacatgataaatatttagttgtttgattttttaaaaaatatattaactagaaagtccatgattcagattagaggaaaaagtaaaaatgtattcgtagagctataatgtcaaccctaaacattctttatgaatgtcagaagtcacctgcagcattgatttatctatttctttctttcttttttttttttttcttttttgagacaagtttcactcttgttgcccaggctggagtgcaatggcacaatctcggctcactgcaacctctgcctcctgagttcaagtgattctcctgcctcagcctcccaagtagctgggattataggcatactccaccaggcctggctaatttttgcatttttagtagaaacggggtttcaccatgttggttaggctggtcttgaactcctgactgcaagtgatccgacccaaagtgctgggattacaggcgtgagccaccgtgcccggcctgaattctctatttctaaaatatagtttcacggtcagattcagaggttgacataaggataaaggaaagagattggaaggtcctgttagaattcatgtttaattatccaatctttattcaattgaaatgatttataaaaattaggcaatacaaggtttctgtatgcagccatatgcagtagtggtctttaaagcagggtaaaagcaccataggggtatgcaagatgatctgttggggtgaggaaagacatatttctatttatttccatttttactcatttttattataaaaataaaaaaacacactctattaatatttaataaatatgttggccctggagtatgtcaggtgattacaaatcgtatgagtcccccaattcagagaggttaataatggcatcctcacttgtttgtttgccctcagagtattatagcatattgcagtttaagtactattttattttattttaagagagtcttgctctgtcacccaggctggagtgcagtggcatgatctcggctcactgcaacttctgcctccccacttcaagtcggattctcctgcctcagcctcacgagtagctgggactatgggcatgcaccaccatgcctgactaatttttgtattttcagtagagacaaggtttcactatgttgcccaggctggtctcgaactcctgacctcaggtgatccacctgccttggcctcccaaagtgttgggattacaggcgtgagccactgcacctggcctatgtatttttttttgagatggagtcttgctctattgcccaggctggagtgcagtggtgcaatctcagctcactgcaacctctgcctcccgggttcaagcaatctccggcctcagccccccaagtagctgggattacaggtgtgcaccaccacatctggctaatttttgtattttagtaaaggcggggtttcatcatgttggccaggctggtttcgaactcctgacctgaagtgatctgcctgcctcagcctcccaaagttctgggattacaggtgtgagccactgcccccagcgtaagtgatttattttaagtgtcttttatttttatttatttatttatttatttatttatttatttatttatttatttatttttgagatggagtctcgctctgttgctcaggctggattgcagtggcgcgatttcggctcactgcaacttctctctcccaggttcaagtgattctcctgcctcagcctcctgagtagctggaatcacaggcacgtgccaccatgtctggcaaatgttttgtatttttagtagagacagagtttcaccgtgttagccaggatggtctcgatctcctgacctcgtgatctgtccgcctcagcctcccaaagtgctgggattacaggcgtgagccaccgtacccggctgagctgccacttttcttgatgagtcctttgtcaactacttcgccaagcaaaataatggcagatcattaactataacatagtcaaacacattgctccctttaaatattattatatcaacaaattatggctgggcatggtggctcacacctgtaattccagcactttgggaggccgaggcgggcagataactggaggccaacagttcgagaccaacctgggcaacatggtgaaaccctgtctctactaaaaatacaaaaattagccgggtgtggtggtgcgcagcagtaattccagctggttaagagtctgaggcatgagaattgcttgaacccgggaggtggaggttgcagagagctgagatcacgctactgcactcccgcctgggcgacagagcgagactctgtctcaaaaaataaaaacaacaaattatttgtaatttttaagttatagcaaagaagtttttttctattaagatgtaaattttatgtatattctgtttatttcatctatcaatcctttaaaaagtctatttctgtatatattttatgatatacataagtatcatagtacatatagataacttaagaataaatatacggccaggcgtggtggctcatgccagtaatcccagcactttgggaggccgaggcaggcggatcatgaggtcaagagatcaagaccatcctggccaacatggtgaaaccccgtctctactaaaaatacaaaaattagctggatgtggtggcgcgacctgtagtcccagctacttgggaggctgaggcaggagaatcgcttgaactcagggagcggaggttgcagtgagctaagatcacatcactgcactccagcttggcgacagagcaacactctgtctcaaaagaaaacaatatatatatatacattcagattgtgagcctcccacctgtttattgattcttgcatgatcaagaaagcttggataccactgatatttagggcatcagatttttatattttctatacgctaagactgttgtttttctcaaaagcaagagcaatctatgtttctgccttcagagttcacagttgctgttattttaaaaagaggaagaaccagtattgcccaaccttcttctggcctttttcatatggactttttacttgacatctttgtagatatgctcttgtgttttttaattacaaattttaaaaaattattatttatttatgagatggagtcttgctctgttgtccaggatggagtgcagtggcgcgatcttggctcactgcaacctctgcctctgaggttcaaacgattctcctgcctcagcctcccgagtagctgggattataggcacccgccaccacccctggctgatttttgtatttttagtagagatggggtttcaccatattggccaggctggtggtgaactcttgacctcaggtgatccgctagcctcggtctcccaaagtgctgggattacaagcgtgagccagtgagccattgcgcttggttgtattttttaatatgatcaaagatgtacagatatagggaaagagaaggagagagaacattgattcttttacagcagtggttttcaactccagctatactttacaattataggggcctgtgttctactctctgcctattgaataaacaaaacaaaaacaagtaaggcaaaaaaactctgagtgtagggccaaggaatctaagttttaaaaggcttcactggtgattctatagagcagtgggttcccaaactttgctgcatataagaatcacccaggggagccttaaaaacactgagaccaaggtcacaccacagaccaattgaataggttgtgggtgggtgggaggtaagtatccctagtttttgaagatccctgggtgatttcaatgtgcagcaagtttgggacccactgctgtagagatcagattttaaaaagtctgcccttatccttcttgattgaaaagctcagggcagagaggattttagagtttgaaggaatttggaacatagctctttttatatggctttgaaatccacaaaggaagtgaaatcattcttttatgctgaaaggtacaagtgtaaatgtatttgatctctgaaaactgaatgtattctgaagaatgtaccctacctcttggaaacataacctgaaataagaaatatttaattttagtcacactggtatgttttcacaacctataaatatcaattgagtttttgataatctgatgtttttgaacaatcacccaaccaagatgagctgtatgtctaacacataagcccttcacatggcaggttctcaatagctgcttatcaaacgaatacaaggctcacagggttagaggcttagaaagaagaatgtgaaatgtatgtattccagcttagtgttcatttgtaatctaggtacaacacaacagttttctgttctcccaatatgaattgtaagatcaacttatagtatttccacattacaagttatatttcagggggaaagtcttcatttataaaaactttcaagttaaagatgaattttcaaatgttactaggagaaactatccgcgtatctagcagacatttataaaaaaatccttcaagagtttaaggtagtgctgtccagtagaactttccatgatgatggaaatgttttatatgcacattgtccacagggtaaccagtagttacatgtggttattaaatcttgtccttctaacaggttgatgaaagaaaatgaagtgaaacaaaacccttgtcatatgtgtgacatatgtgtgactgaataactaaatttttttatttttagatggagtcttgctctgttgcccaggctggagttcagtggagcgatctcggctcactacaacctccgcctcctgggttcaagtgattctcccacctcagcctcccgagtagctgggattataagcactcactgtcatgcctggctaatttttgtattttggtagagatgggggtttcactaagttgaccaggctggtcttgaactcgtgacctcaggtgatccactcactttggcctcccaaagtgctgggattacaggcgtgagccaccacgcctggccagaactaatttttttttttttcttgagacggagtctcgctctgtcgccaggctggagtgcagtgtcgtgatctcggctcactgcaacctccacctcccaggttcaagtgattctcttgcctcagcttcctgagtagctgggactacaggcgcgtgccactatgcctggctaatttttgtatttttagtagagatgggatttcaccatgttggccaggatggtctctatctgttgacctcgtgatctgcgtgcctcagcctcccaaagtactgggattacaggtgtgagcgaccgtgcctggccaaaactaaatttttaattaaattagttaaattaaaaatataacagccacgtggagctagtggctaccatactggacaacacaaggttgggcttaagaaggtacaaaacagctttttttgatgttctggatctagaaattattctcttgctattgtttctaacacactactatcttgccaatcaagcaatgtaaacacatactctcgatggcttcatcatatctaattgttggcaaaaaattaaaaattatgaaagcatttttttttttttttgagaaggaatctcactctgttgcccaggctggagtgcagtggcacgatctcaactcactgcagcctctgcctcccaggttcgagcaattctcctgactcagcctcctgagaagctgggattataggcacctgctaccacacccggctaatttttgtatttttagtagagacagggtttcaccacgttggccaggcttgtctagaactcctaacctcaggcgatccacctgcctcaaaagtgctgggattacaggcgtgagccactgtgcctgccacttttttttttttttttgagacagggtttcgctctgtcgcacaggctggagtgcagaggcgcgatcacggctactgcaacctcaacctcctgggctctagtgatcctctcacctcagcctcctgagtagctgagactacaggcatgtgccaccacaccgggtaatttttaaattttttgtagaaatggggtctccctatgttgcccaggcaggtctctaacccctgggttcaagtgatccttccacctaggcctcccaaagtgatcggattacaggcataagtcactgcacctggtcctgaaagttcctattagagggctacattattctaaaataccactgctgataaaagaaaatacatatgcgtggctgggcgtggtggctcacacctgtaatcccagcactttggaggccaaggcaggcggatcacttgaggccaggagttcgagaccaacttggccaacacagtgaaaccctggctctactaaaaatataaacaattagccgggaatggtgatgcgtgcatgtaatcccagctactcgggaggctgaggcatgagaatcgcttgaacccgggaagcagaggttgcaatgagctgagatagtgccactgctctccagcttggggaacagagggagactctgtcctccccacccccaccccccaaaaaggaaaatacatacaggcaaaaaaatttaaaattgctcagatcatttgctcagccaacattttgaaagcaaatatactttggagatttaaatgataatggaatttgtgaaggaaaaatcaatgagatcctgaatcttgtattcagaatgtatcatcgaatttctaataatagctcaatcaactttttttccatataagttgaaacagaaaaggacaaactataaaaattatttgtcatgaaatgtgtgaaatatagagggtaagatcactcgacaaatacttgaatatattctaatatgccatttaaaaaaaatttttcttgtcaaatgcaagtaacagcaaattgatttagcaaagttacatgtaaaaaatgctcttaatttctgtcttaatttgacaactaaatattcaaaccaaggtccccatttgatttgcttcgcaatgctgcaaaattgtatactcttcctaaaaggcataaaggagaagtaaaacagttacaaaacatgctatcttcaggctgggcatggtggctcatgcctgtaatcccagcactttggaggctgaggcaggcagatcacttgagttcacaagttcaagaccagcctgggcaacatggcaaaaccctgtctctacaaaaaatacaaaaattagccaggctttgtggtacacacctgtcgtcccaactacttggtaggctgaggtgggaggatggcttgaacccgggaggcagagggaggctgcagtgagccaagatcatgctactgcactccagcctaggcaacagaaccagactttgtgtcaaaaaacaaaacaacacacaaacaaaaacaaaaaacaaacccagaaccaaccaaacaagaaaaccccatgatatccttggaattaagaaaagaagaagaagccgggtgtggtggctcacgcttgtaatcccagcactttgggaggccgaagctggtagatcacctgaggttgggagtttgagaccagcctgaccaacatgcagaaaccctgtctccactaaaaatacaaaaaaattagctgggcgtggtggtgcatgcctgtaatcccagctacttgggaggctgaggcaggagaatcactagaacccaggaggcggaggttgcagtgagccaggatcgcaccattgcactccagcctgggcaacaagagaacaagagcgaaactccgtctcaaaaaaacaagaagaaagaaaagaagaagaacaaaaatagcagatatataggaaagaacacttcaatgggtgaagtggtaatgtctttccataattcattaaaaggagatcttcaacatagaggagtagctgatgatcttaaagcactcgctagtcatgagatggtccttctgaatttaactgcagcgtgcaatgaagatttttatttctctattttttttttttttgagatagagtcttgctctgtcgcccaggctggagtgcagtggtatgatcttggctcactgtaacctccgcctcccaggttcaagtgattcttctgcctcagcctctcgagtagctgggactacaggcacacgctacgacgcctggctaatttttgtatttttactagagatggagctttgccatattggccaggctggtctcaaactcctgacctcatgatccgcctgccttggcctcccaaagtgctgggattacaggtgtgagccaccgtacccagcctatttctcttcttgtagaaatttctgaatcagaattagaactatatatgctatcataattgtaaaatccacttattgtaagaatgaaatcacatttctacctataagtactgactttttcttggttggataactgagaaaacatttgaactgcaactcttgcttgtccagctcagatctccttcgacatgactgccagcataagctatctacaatgcaaatctgattctgtcacttcgagcttacaaatacttcatggcatcccagtgcctaaaggataaaggctaagctccttagggaggcacagaggaccctctgtgacctgacttccagctgttcctcctcctgctgttttttgcctttaccttatgcacgagagcaacacccaacagccacatttcctagaaggtgtcactctctctctagaagatatcactctttctctcaggaaagtgagaaagaaaaaaagcagtcaggccgggtgtggtggctcccacctgtaatacaagcacttcgggagatgaaggcgggcggatcacctgaggttgggagttcgagaccagcctgaccaacgtggagaaaccccgtttctactaaaaatacaaaattagctgggtgtggtggtgcacacctgttatcccggctactcgggaggctgaggcaggagagtcacttgaaactgggaggcggatgttgcagtgagctgagatcgtgccattgtacttcagcctgggcaaaaagagcaaaactctgtctcaaaagaaaaaaaaaaaaaaagaaaaaaagcagtcctgggctgcggtaagctaaactgtcctggttctaacatctaggcctggggttgtcctgttgaaccgaaaccaggccactctatgagcatgctggagcaagacaaaaataagaccactttacagtgagctgagatcaccccactgcatgacagtccgggagacagagcgagaccctgtctctaaaaagaagaagaaaaagaaaaaaaaccactccacagtcatgtctgagcacagacaaaaacacaaatgccataaactacaaaaaatgcgaaacatcttcctctcccagctaatatgagtgactgctgtgcccttactaatcacagctttaccccaccttctagataaaaattcatcatagaattatcaaatccagagcaaaatattgattctttaaacccttcccaaagtcacctactgcaagtctaaactgcaacaagttcctctcaactctgcactaagatgccccatggttcttcatggtgtgctttcttcctcactgcaacgaaccaagaaacccaacttgttcaactacaagtgtgttcctttggccaaaaggcactgacacaaggaagcttttcctgtctgccccaggctggctgaggactgccaccttctctgttccaaagatgtcctgtaccttacagcactgcattatgcaggctatattgtattgaaattctgtccatccatgtctgtctccctctggagaccttgggccccacaggaaccatgttttatttttttcctcttattcatttttaagtcctcagctgacaaagaacctaggtcatagtaaagtttcaaaaaaaaatgtttaaagaatgaatgagtagatgctgcacatttcttgggtccaagatttaaagatgcagcttcacgtaacacatcattttacaacactgtcaactataacgtcatgtgctttaagaatgcagtctggttgtacaaggtgactcatgcctgtaatcccagcattttgggagtcttaggcaggaagactccttaagcccagcagtttgagaccagcttgatcatcatagcgagactccgtctctacaaaaaataattagctaggcatggtggtgtgcacctgtagtcccagctactcgagaggctgaggtgggaagactgcttgaacctgtagggttgaggctgcactgagctgtgatggtgccactgtactccagcctgggcactgagctagactcaaaaaaaaaaaaaaaaaaaaaaaggaatgcaatctgggcttctcctcctaactctcttgcctctgaatattcctttttccgaagtgtgtcgagaaacaacctaagtttggagagattaagacacatatcgatgtagagaaagcttttttttttttttttttttttttttaagacagggtcttgctctgttgcccaagctggagtgcagtggcacaaacacagcttactataccgttgacttcccaggctcactcaatcctcctgctgcagccagccgagtagctgggactacaagtgcataacctcatgcttggctaatttttaaattttttgtagagatgaggtctcgtcatgttgcccaggctggtctcaattcctgggcccaagcaatccttccatcttggcctccctaagtgttgggattacagatgcgagccaccacccctggccaagggaaagctttttaaaaaatttaaacaaactcaaaagttttatcagttctggaagatcatgataaaaatgaaatattggagaaagcaagctgttacccatcaatgttgagaaaatgacaaaacatatcaagttttacatggcaacatctgtttataatgtgttaaattttttttacctgttccttaaggggaaaaaagtgggtaactcaattaacatcaggtaggactctaaactttcaaagtaacttaacttatttatttgagacatggtcttgctctgttgcccaggttggagtgcaatggctgatcatagttcactgcaaccttgacctgctggacttaagcagtccccttgcctcagcctcctgaggagctggaactgcacttgtgtgccaccatacccagctaaaactttcttttttacttgtattaattttttttttttttttttttgctgggaagactcagacccaagtaaccttggatatgagctctccacctggttaaaactttattacagtgctgatttcttctgtttctaagtttttgccaatctttggcaaagatcaagacaggtcataattcttaaagttcagctgcttgtagagacatttatagcaaaataaaaaacttaaaaagaaatgttaaagagtacatttttccttctttttagagatggggtctcgctatgttgtccaggctggtcttgaactccagggctcaagaaaactgcctgccttagcctcccaaagtgctgggattacaggcgtaaatcaccatgcccagccaagactaagtttttaattttactgcctggttatattgtatataaatatttaaaatatcaatcttgggctaggcacagtggttcatgcctgtaatcccagcactttgggaggccaaggtgggaggatcgcttgaggccaggagttcgagaccagcctggccaataaggtgaaatcccgtctctactaaaaatacaaaaaattagctgggagtggtggcatgcacctgtaatcccagcaactcaggaggctgaggcaggagaattgcttgaaccagggagatagaggttgcagtgagctgagattgtgccactacactccagcctgggtgagagagcgaaactccgtctaaaaaaaaaaataaataaaataaaataaaatatcaatcatgacaatttaataggaaaagtcttaaatattttatgttcttaaactaataaagtgactttgaagccaacaagaatgctgaaaacaaactgtgtatattttaatctttcctaatgtttttatgttcttcttttattctactcaaaaggcaaacattttgtttccatggtttgagaatttagtatattgaattattatagatttttatttgtgatttgcctttgtgctcgattaagtgattgaaatctggttttaataagatataaacttttttctaaagacctactctagaagagcaaacagatgtatatcatattataatattatatcataataaatgtgctgttctctttctttaatgacactcatttaaaatatagatacaggtccaatatcccttgtctgaaatgcttggaaccagaagtgttttggattctggattttagaatatttgtatcacgtaccttcccaattaagcatcctaaatcttgtttttcttttcgagatggagtcttgctctgtcacccaggctggagtgcagtggcacgatctcagctcactgcaacctctgcctcctgggttcaaggaattctcctgtctcagcctcccgagtagctgggactacaggtgtgtgccaccatgcccagctaatttttgtatttttagcagagatggggttttgtcatgttggccgggctgatctcgaactcctgacctcaggcgatccgcctgcctcagcctcccaaagtgctgggattacaggagtgagccatcaggctggccaagcatcctaaatcttaaaatccaaaaatctgaactctgaaatgctccaatgagcatttcctttgagcatcatgtgggttctcaaaaacttttggatttcagagtattttggatttagaattttcagatttgggatgtacaactgtataaacacactagttggttttctaacaactaatggtcagaatgagaatcctttcatgaataacacattttattttctactaatcaagtggaaaaaacaaacttaagactcatttgataatcactacactaaaaggttttaaaatgacttaaaaatattttttatagtttataaaactatactttctataaaaaatgaaagaactgaaattcttcagacaatactttgttcatatttatgtatttaaaatttttttttaaatattttaaatgttttgtagagaaagggtctcactatgttgactaggctagtctcctgacctcaaatgatcctcccacctagacctccccaaaggactgggattacaagtgtgagccactgcacccagccagacaatactttggatgttcatttcatttgcctattctactttgtctagagcatgcacaataggaatatatatttttaaaaactgatatcttaattctgaagaaaaaaagtttctgacattatttttaaaatgtgtcaaagtccatacctgatttcttaatgatgaaagaatgtattccttttcataatgggaaattctcttgtgtttttgtggtgtgtcactaactaaccagatccacaaaagaaaccaaaatattccaatagtaccttaaaatagaaaaataatagttagataaaattagaatgtaccaaataacaaacaaaacaaaacaaaaacacaaaattagaaagcaccaacaacaatttttacatgtcttgaaaaaattatgtaactataaattcaatgtaaaactgacttcagtttggattcaatttcaagtttctctcaattctttaatgggataattgctataactgtattattgcttatacattttgaagaaaacaacttttttttttttttttgagatagagtcttgctctgtctcacaggctggagtgcagtgacgtgatctcggctcactgcaacctccgcctgctgggttcaagcaactctactgtctcagcctcctgagtagctgggactacaggcacgtgccaccacgcctggctaatttttgtattttgagtagagatggggttccaccatgttggccaggctggtcttgaactcctgacctcgtgatccacccgcctcggcctcccaaagtgctgggattacaggtgtgagccactgcacccagccagaagaaaacaacttttaaccacatgactttgcctatcagggtctaccagacaaatctttttgaagatacatttccacaatctacatatttccaaaggtgtctgtttttgttagttgagttttaaattttgattgcagatatatttcttgcatgacatgtctatgtgaaaatctaatttattaaaaatgtgtatcatgctgccaaggaaattgagcaataaaatgccttgggactaagtaaaaagaaaaaaaaaaaaaaaacattaaaactaccaagtgagaacatcctactttgcttgagaagaaattcaaaatacctaagatagtgattttttgatagcaaatgtactatttaagtacaggatcaacagtcatttctactgagaaatattccaaaactaacatcagctcgtaactcaaataggtcaagtaaatcataccaacttgaaaaacaggttatcaggaagtgtttcagaactgtggttcagtgatttggaagatatatttttaaaacattattaggctactattattacattttgaatttgttacattataatttagttaaaattttaaacttaccaaaaaagtagaagacataagtccaattcatatagtagcaaattattccagaaagaggaagagaaattactgtcccaagctgtgctcctagaacaacacataagactattttataaactttggagagagaaacaaggataggacagacaagtctactgcttacagaggatgggtaacaggctgggcacagtggctcattcctgtaatccctgcactttgggaggctgatgtgggtggatcacctgagcctaggagtttgagaccagcctgggcaatatggcaaactcctatctgtactaaaaatacaaaaattatctgggtatggtggtgatgcacgcctgtagtaccagctacttagctacttgggaggttgaggtgggacgatcgcttcagctgttgaggctgcagtgaggggcgattgtgccactgccttccagcctggagtgagaccctggctcaaaaaaaaaaaaaaggctaaaatgtggtcccatagaaacaagattagaaaaaagatatagaggtagtataacaggacaagcaaaggaatggaagtagtaaagcagagagtaggcttgggaacttcatttgggtaaaggaaaggaaaagcagataaagctggaaaaataggttggacagttgaacagttactgagtacctactccatgctaggcactatctgccagagatataaggctagctgcaacaaagtagtgaagactgtaaagaatcttgcccctagttcaaggagtttgggatttattcaataggtaaaagggaaccttagatagtacctgttcttgaacctatcatcagatttctcatgtcaatctcaacatagctgcaagaataatcttcttaaaatgtaattgaatcatgcctcttaaaaaacaatctacattttttcctgtagcctgtaagacctgatataacccggctcttatctctttctctaacctcatcttatgccatcatcctccttactcactgagttctagccatccaaggtagttttccacttcttttaacccttatgttatttcttgcctgagtgccctcgtacatgctgttctgattggctgaaatgctcttctccctgcatgaatggtttgttcttatccttcagattttagcttaaaagtaccacagagaggccttttctcaactactgtatttaaaaagcagtccggtggaaaaattttaatttagtcaatgaaagaaaggctagaatttcttatgcaatctgataaaattataattcacatatataaaactcatgttatctcacctgtagatcaaaatgatggcaaataaagatgcaatagaaaaaagatgcatgaagagaggggttgagaatcatgatacattcattagttaatcaaaacagaaatcacaatttaaggacaaaaacactcaattttctagctactggcctttttttttcttttttttaaatagcatctctaaacaaacaaaaataaaatttaaaacccccaaaaaagtaaacagaaaaagaaaaaaaatagcatctctataccaatatctgaaaacacaacatactttgaaatagatgatggcagatggggaaaatgacattagtcaattaagctgcattactataagttgttgagccaaagagaaaaattggtaataaagttatactaccgaaacttaatgttctccccaaaggggcatccaatccaacattgcatcgttctggtatgcaggccctttttcccaaaggttgatatatacataacatattacagcaaaatttggtaattgttatctcacctgcatatgaaatgctaagaagtttgcttctttcaagagggggagcccaagaagaccacatggcatgcatggctggaaatgtaacaccctgagagaagggaacatgatatttctgatgaaatgtaaggtagttttgttaatgctttaaagtaagttaagtattttgctacaaaagcattttctggataagaatcaaacgaatcaggttccatgaaatgagaaatttttacagtgttaagtgaaaatatcttataatgaagtactttcagaatttgaggctgggtgtggtggctcatgcctgtaatcccagcactttgggaggccaaggcaggaggattgcttgagcccaggagttcgagatcagcctgggtaacgtagtgagacaccatctcttaaaaaaaaaaagtaaaactccccaaagattcatggattttggaactggttttaagacaacaagataagggttacaataaatctaaaataattgtactgagtgaggacataaagggatcttgctcaaggttaattttactcattcactttattaatcacctgaatgaaagggaatattactaacttataactttaaaaaatactgagctaatattttgggatactgaaaaaaaattcaagctgacaatcaaccagaaaaacagtcctattaaaaaaaggatgaattcaattagcatgtttacagcctttcttcttttttttcctgtgataacaagcctagtagatgccaattactgacacggagagctaacaggatgtggaaacagggagtttcatagagactgggtaaatgaggagataccacaggacagtgagagagaacggctctccttggacactctctgtgtcacttcagaaagattagttaacctccctgaacttcaaggcggttgcataattgttgtaaagataaatggtaactagtgctattattagtggagagaagaataaatgttttaatactttgtactttccgctgactctttcaaaaacaaaaacaaaaggaattaaaaaaaagtaataccaatggaaggcaaagatgatttaggtacattgcaaatcaataagaatctatatgatggagcatccacaggatgagtcattatagaagaaaacttgagatgtttggaaatgcccacagagattatgttgtagaaaactttattataaaacctagggacaatgtaggtatatttatggtgaatcagatggtaggaatgcaagatagtaatctaagtgtcctttatgaatgaggaaatgcacctgtgatacatattgaagggatgaagaaggacgagagaacctgagtataaatacaacttaaattctatttagttgttggctggacacggtggctcatgcctgtaatcccagcactttgggaggcggaggcaggtggatcacttgatgccagaagttcgagaccagcctggccaacatggtgaaaccccgcctctactaaatatacaaaaattagccaggcatggtggcgcatgcctgtaatcccacctacttgggaggctgaggaaggagaattgcttgaactcaggaagcggaggttgcagtgagccgagatcatgccactgcactccagcctgggcaacagagtgagactccgtctcaaagactagaaaaaaataaataaatgaataaataaaatgtcacctgagataacagtggtaatatgatcaatatgccgtaatgttaaattagtggcataaactggaagtaaaatatgggaatacattcagcaaggagattgaatactaggatcagagaaaatatgctagatttaagtatattttactttgtcaagaagaacaggaacctggtaatagaggagtaattttaattttgtgatcaggaagggtttacttaatggacctctactgataagaacaaaataaaaacattcagatgaatgaaaaatcttttaatagtacctggcaatttccaaagtattctagcaatccttatcacatatgaattttatatctaatctgtgactgaaaacagggaaggtattttagtcccagtttaaaaaatgatgggactgagatctagagattagagcttacctaaggtttcactgttagatacaatagagctattattcaaactctggtccagtgttcattccaacagcatgatacactgctacttaaaataatcttcatcctctacaccaagcccagtggccattatcttgcttgaattaaagaaatgcaagagagcaaaatacaccattccctggatttcagaggtagaagttcgaagttataaaggaaaagtgaaaattattaagtatgggggtacacatgatgaaatacaaaagaaaagtgggaaggaaaagaaagacaagaatcaaaattttaaaaaatgataaaactattaagaggagggaaataaaagaggcaaaaatcaataatacttctaaaaagagcagaatcatagaactaaattgagatagttatataaaatcataaaatatttgtctctaagttacaagaccagaaaaaataaaagaataagcgataaaaaagaaattaaatgcaactcaacagtctattgtgtaaaatgtgcttcagacttgggcatcaatgatagagcagagtttaacggtggcaagagcacaagaggtaaggatggtcaatcttaaccatttttttttcttttgagatggagacttgctgtcgtccaggctggagtgcagtggcgcgatcttggctcactgcaacctctgcctcccgggttcaagcagttctcccacttcatcctcccgagtagctgcaattacaggtgtgcaccaccatgcccggctaatttttgtatttttagtagagatggggtttcacctgttggccaggctggtctcaaactcctaacctcaagtgatccacctaccttggcctcccaaaatgctgggattacaggcatgagccaccacgcccggactatcttaaccatttattaatggtttattttcttctctcctaaagtatgagctatgaagtctcttttggaaaaaagttttctctggtttttgagtaaaggttccaatttcggggtgctcctactagagacctcatttaccacaaacaaaatctattcaggtaattttctagttagtcctttctctaaaaaataaacccctgttatcatccaacgttattttttggttcatattcataccaaagaatgacatctttaagaagaagagaaggagacacacggtaagaagtaaaacaagagagaaaagaaaattacctctcctagtccttctagtgctctgagtacaatgagtggtccaactcctaaatctgcagcaatgggagtgaacagggtgaggacagcagtgccaaggatcccaaatcctagcagcattttcccccctattttgctggcaacatatcctccaggaatctgtgtgatgatgtagccataaaaaaaggaaccgagaatccatccttgagtttctgcatcccattggtacttcttaccctacaaaaatcagaaaagaataaaacaatcctttaagaccttcacagagcagctcttttctcttactggcatgtaagtacatataaatgagattttgaaccactattttggactgaagaacatgcaaactttctagtaggtgggtgagtcataacaatatagatatacagtatttagaagtgaatgaaaaagaactgacagtcgtaaacttcaagaaggcttgcaattttataaaactagactgcaggatgagctgccagaagctttataataactatgaccaagaaggctcacaaaagaatcacaaaaaaggcttgggtatctctgagcctactatggctcgggaggctgccgcccccccggccctgcctccccctcccaaaaaaagagtcacaggcttaatccagaaagctattaagcagaaaactgtagtggctgagctaggctttgggaaccaggcttggttttaatcctagctctattacttaccgaatgtgtgatctgggaagaggaaatgaaataggcacataaaataaggcttgatgtacagttagtgttcacttagtgctggctattaacatgcataaatgtagatattaataatatctccccatttcagacgaagcacttaaacaagcacatggaacaattccaaagagcaagaatttaaatcaagccacaaacttcatgtgaatagaacctgtgttttcattagtaacagcacacagcaaggtactaatgaagatttagtgactgatctgagtatctgacatttttaatgcagtgtagctgtataacaaagccaacatgtcaagaaccattccgggatttctttctactgctgatataaggcagatgaagataagtagcagggtcaacaaaagcactttgcaaagaaaaagacacaaagcaaactcttacttttccttatttagggtaccaatttgcagtttatctgtggaattctaggatttcatgtacattccagcagtattgtccctgaaggtcacaggttggagtggagaaagtgagtgatgtgtacccaaatgttactcagcaacattattaaagtcaaatataaagattttcggagagatttattttgtttagagagaaaccctctttcctgcttgaatgctctgcttgtgaatgatagaggagattcatctaagtatgaactagtatcttcgtgagcactgaaaatgggtgaaaatttatttatttatttatttatttatttttaaattttttttttgagacggaatctcgctgtggcccaggctggagtgcagtggcgcgatctcggctcactgcaggctccaccccttggggttcacaccattcccccgcttcagcctcccgagtagctgggaccacaggcgcccaccacctcgcccgtctaattttttgtattttcagtagagatggggtttcaccatgttagccaggatggtcttgatctcctgacctcgtgatccatgtgcctcggcctcccaaagtgctgggattacaggtgtgagccaccgcgcccggccaaaaatttattattttttatttatttatttttttgagacgaagtcttgctcttgttgcccaggctggagtggaatggcgtgatctcggctcactgcaaactccacctcccaggttcaagcaattctcctgcctcagcctcctgagtagctgggattataggtgtgtgctaccacgcccagctaatttttgtatttttagtaaagacagggtttcaccgtgttggccaggctggtctcgaactactcacctcaggtgatccacctgcctcagcctcctaaagtgctgggattacaggcatgagtcactgcacccagcctgcaaatgtacttctaaaaagaatactagcttttctttctgtactatctcctcgtgtgataagcaacataaaatgaagtatatataacttaattataaacaaatgatgaatacacatttattaataccactataacataaggcaggcaaaatgacttatgtggcttaggttgggcatgtgtacattcagaaaagaatgtcctaagaaactggccagttcttgtttttcatcttgcaactgagattacctaaactctcttgcagctgtaactctataagtgatatagggttataaataatactcctataaaagctatttagaaaatttaaaacagtttaattttctgttatataaaacaggtttttccaaattttctttaagcatggtatgtttatagagggaatggaagaactacttttcaaacagatgaaggtgtattacggcatagcagtagtagctatagttacaagttattgcccaatcagttcctgggaaaacacaaaaagaaagtgattcagagtatacacaaacaaagtatagtttctgtaggatgaaaaaagaccttttaatatttttacttgcaagtattttaggataattaaaattgtttccttaaaaaatagcacctaccgtttgattatgatgaacttttatgggagcagaatgctctggacacgccttggaagttctattatcttctaaagttgtatttgaatctaccatatccactaacgcaacactcagattcacacgtaatgcatacacaatgaagaaaccaaaaaaggccaaaattgctaagttgtaacgagcagagcagcacactggagctgaaataaagattggggaaaatttttatttatttttaaatttttatttttagagacagggttttgccatgttgcttaggctggtcttgaactcctgggctcaagccatccacccacctcagcctcccaaagtgctgtgattataggcattggccaccatacccggctgctttaattaaaaaagttaattacatgatattgtctaaataatgaaaaaggttgctttttaaaagtacaaaaataattatgaaaaaatgttaaagaatattcttagattaagcaaatctaagaaacatttgtcaaagattagctgtttctcatatctgtagttttggtaaaaatttcacacatgagagcctgaactataaaaaagttcattaaaacatggaggtagtagttttatcacctttgctgagaaaaagatctattccagattcaaactgaacccctactccttgtcagctggcaaagatatacggcatgagaaaagcaggtaaggaggtttaatggcattactatttctgaaaaactatctgaaacatggtcaataagtacttgagtacttacaatgacatgatatattactgattatgagttagtagccatctcattgttaaatgtagcatagcaaaaaaaatttactgccaagggtagggcatgaaatttctcttgataaatttcttacctcgaagagtatcctcaaaggctgggtttgaatcagaagccatgattaatacttaaagccatcgtaaactaaatgcatttaagaatctagaagcaaacttgcagaacctatgacagttgcagcatctgtgacagttgctcagtagttatcaagcgtaaagggctcacagtaaaaagggaaatcagtgaatgtaccaccatgattaaaaaaaaaggatgccgggcacagtggctcacgcctgtaatcccagcactttgggaagccgaggcgggcggatcacctgaggtcaggagatcgagaccatcctggctaactcggtgaaaccccgtctctactaaaaatacaaaaaattagccgggcgtggtcgcgggcgcctgtagtcccagctactcgggaggctgaggcaggagaatggcgtgaacccgggaggcggagcttgcagcgagaggagatcgcgccactgcactccagcctgggcgacagagacagagactccgtctcaaaaaaaaaaaaaaaaaaaaaaagaatgcagagtaggttggaggaaccaataaaaggatcatgtgagaggaggagtttgacctatttattactctaactgtgggcttatgcatagtttctcttttttcttcttttattgagttgcagaattggagagggataggattcaggatgctgactaaggataatcaacctcttagtaacaaagagaaattagctaatccagagtctgaacatctttaagtttagtaaactctgagtggctgataaatacctctttaaagatataaacatgtatttcattaagcaatgacatattaaaattaaatgaaaatatgtgtgcttttatttggtaatgacacatcaacatcatataaatgtgtgtatgtttttcccctacttaagaatcctggtgttttcattaacctagcatcaaaggagagaatatattttacagaatacaaaagtcttgatactggctcagatgaactgatttagactgaaacattaatgaatatgcacaactatacttaggtttatattaatatattatgatccaactcacttttctgtatgccctcctatgtttaacaactgctattatttttttttccctgtgtaagattaacttcttttaacaggaaacttttcatttggcattcttaaatcctttcttcaggggtacagctatgaaatttatggtaccactaccatagttagatccagatctgtaagaactgaatttctaaagttctattcacattgtctctattactagaatctaggcgaatttgctttctgctgcaaccaaatgggcagttgtccagttaatgacggtttggatattgtgaggcatgttttgtaaaaaaacacattttcttttttctttctttttttttttagagacagggtcttgctctgttgcccaagctggagtacagtgggtgatcataactttctgtaacctcgaacccctggactcaagtgatcctctcacctcagcctcttgagtagctgggactaaaggcatatggcagcatatctgactaatttttaaatttttacttgtagagtcggggtctcactattttgcccaggctggtcttgaacttttggcctcaagcaatcctcccatctcagcctcccaaagcactggaattatagacgtgagccactgtgcccagcagaacatgttttctttatcattgctctgtgtcaggtgatattacctagaagtctggatgggggactcaaaaatctagctaaatgtgtgcattaaaatgtgttactttgagcaatttggagcaagaaaaacccagatttatgtactatgtctgttttgtcaatgcagcatttaaaaagatcattacctatttcagcaaaggagtgatgagatgtgatttatggtttaaaaagcttatctggttgatggtttaaagagctcatctggaccctgcatggagactatagaaaggagaagtgtgaagggtgtaaggaatgtacagtcagggagatcacttaaaggactactgtagctttccagctaagagatgaaggtggcttaaactacagtgaaagcagcagtgaagaaaaatgggcagatctgagatgtttaaaggcagaattaacaggccttgcccaaatgttagatgtgggagtaagtgaaggggagggatgaagttattagtaattctcttactctaaaaaactctattttatgctactgtaatttgtaatgttattacttcattctatccttatttgcagttatcttattttactgtacattattagttttccctaagtgatgctttattgggactatgatataccttatcatgtgaattacaaggggctagaatgttgagaaatgaaagaaaggtaagtaaaatgatttcaaattactcgtggtattacttggaaatctgacctacaagttatagatcaggcaactttaacttttggatgcatagtcagtaattagaaaataaaaagcggccaggcacggtggctcacgcctgtaatcccagcactttgggaggacgaagcgggtggatcacctgaggtcaggagtttgtagaccagcctggccaacaaggtgaaaccccgtctctactaaaaatacaaaaattagccgggcgtggtggcaggcacttgtaatcccagctactcgggaggttgaggcaggagactcgcttgaacctgggaggtggaggttgcagtgagccgagatcacgccatcgcactccagcctgggggacaagagcgagacttcgtctcaaaaaaaaaagaaaataaaaagccaactcaggtgtcacaaagtatattactatgagattctaagaaatattaaaaataaacaattactagctaataaaatggttgctgattacaaatatattcaatcagaaaatttttatttcaagaaggtatagcagtaaagaaaaacatgcctgggaatgtgaatattctttgaaattgatccaacaaaagcatgcttgcatgaccaagagagagaacatccattgagcatcaagttcaaagcaaaatcatgcttgcataaggaacatggcacccatcaaaaacaaacatcagcttctaaaatgtgttttaaacttaggaatgtgtgtgggtgtaactgaaagtacacaggctaatttagagtgggacctgggaatgaatctgtttctgatttttcactggctgtgtgcttttgtagaaattacttactagttttcattctcaggtttcttagctataatatgtagagaccaccatctacccactgggctgcatggggattaaatgaaatactgcaagacattatagcaggcacttagtaaaaaggatttcttcctcctttttatctggagaaagttatgccaataagacaaagtactatgtacgtatatataaaaaggaacaaaagaggcacattaatctgatggaggggacagtggagacagtcagagaaggcctcttggagaagtctcttcaaggagcaggaagtcaccagtagggacagatggaacaatccaagcaaaagcagcagcatgtacagaggtatggaaatgagacagataaacatagggagagcaggacattctaaatgatctgcagtatctagattatgtattgtagtaactctaagaactaacactattgagtgggatagtgggtattaagtttaataacataaaataatatataattttttttttttttggagatggagtctttctctgtctcccaggctggagtgcagtggcacaatctcagctcactgcaacctccatcttccaggttcaagcaattctcctgcctcagcctcccgagtagctgggactacaggcatgcatcaccacacccagctaatttttgtatttttggtagagacaggatttcaccatgttagccaggctggtctcaaactcctgacctcaggcaatccgcccaccttggcatcccaaagcattgggattacaggcataagccaccatgcctagacaataatagataatatttattacaagccgggcatggtggctcacactcgtaatcccagcactttgggaagctgagatggggaaggattgcttgagcccaggagttcaagaccagcctgggcaacatgatgaaaccccatctctacaaaaaatttcaaaattagctggttgtggtgttgtgcacctgtaatcccagctacctgggaggctgaggtgggaggatggcttgagtctgggaagtttaggctgcagtgagctgtgattgtgccactgcacttcagcctgggcaacagaataagactcttgtctcaaaaaacaaatattactaagcattttctatacgcttggcactagtcgaagtattttgcctgaattagggttattataaggattcactgagttagtaatgtaaaatacttagaagagtgcttggcacagaataactgtgaattattatgggtttttttttctggaaattaggaattgaggttatttcttaggaattgaggttagttctcatttgtgagaaattgggatctgggaaaagtaagaaattgttgaagagagtgggggcatgaggttctcagtgaaacacaggaatgctgagcagatacccatacagaattggtgggaacaatctgccctagtgtgtaacttcataagcactgcatgcctgtgctcaggagtaggcactaagaaagcagatagctggcaccgagatggatgtgatgacaaagaagggggcaagggaatcgagagtattggcaagaaaataaagtgttgggctgggtgctgtggctcacgcctgtaatcctagcactttgggaggctgacgcaggaggatcacttgagcccaggagtttgagaccagcctgagcaactaagtgagaccttttttctacaaaaaaaaaaaaaaaaaagaaagaaaaaaaggccgggcacggtggctcacgcctgtaatcccagcactctgggaggccgaggcaggtggatcacgtggtcaggagatcgagaccatcctggctaacacggtgaaaccccttctgaactaaaaatagaaaaaattagccgggcgtggtggcgggtgcctgtagtcccagctactcggaggctgaggcaggagaatggcatgaacccgggaggcggagcatgcagtgagccgagatagcgcgactgcagtccagcctgggcgaaagagcaagactccgtctcaaaaaaaaaaaaaaaaaaaaaaaagaaaaagaaaaaaattagccaggtgtggtggcacatgcctgcagtcccagttcttcaggaagcttaggtaggagggtcacttgagcctgggaggttgaggctgcagtaagacctgtttgagccactgcattctagcctgggcaacagagtgagatcctgaaaaaaaaaaaaaagaaaataaagtgttggactttgattgtaacccaagaagaaagcaaaatggagagggctgaaagtttaggaaaatatacactagaatataaaagtctataagggcaggagcttttgttctgttttgtttacttctttgtatctccagtgtctagagccgtgtatgggagaattagcatgctgacacaattctactttctacacttgtattctacttatggaatagtcatgacggtaattaagacagacagactcataatcctatcaaatcttcagatctactaattaccaatttacagtaaatcaggagggcagaagatgttaaaggacaacataaggatataaaattgcagggaaaagaaaaggagcggggcaggggaaacagattaaaagagacaaaaaacatttcaatcatttggaaggtatggacattattgagatcctgatttgaacacactataaaaaattaggacataggcccggcccggtggctcaggcctgtaatcccagcactttgggaggccaaggcgggtggatcacctgaggtcagaagttagagaccagccttgccaacatggtgaaactccgtctctactaaaaatacaaaaattagctgggtgtggtggcgtaggcctgtaatcccagctactcgggaggctgaggcaggagaatcacttgaaccggggaggctgaggctgcagtgagccgagatcgcaccactgcactccagcctgggcgacagagcaaaactccgtctcaaaaaaaaaaaaaaaaaaaaaaaatcaggacataattgaggaaatatgaacactgagtattttgtaagtattattattattttattattattattttttgagacgaagtcttgctcttgtcacccaggctggagtgcaggggcgtgatctcggctcactgcaagctccgcctcccaggttcacgccattctcctgcctcagcctcccgaatagctgggactacaggcacccgccaccacacccggctaattttttgtatttttagtagggacggcgtttcaggcgtttcaccttgttagccgggatggtctcggtctgctgacctcaggtgatccgcccgcctcggcctcccaaagtgagtaagcattatttttatttgctgtgataatagtactgtagttatgttaaaaagagtccttatcttttagaggtaaataattgaaatatttacatatgaaatgacatggtatctgggatttgcttcaaaatacacagtatgtatgagcataaggcaagactggccatgaattgataactttaatctgggtgctggttacatgggggctcattatatacttctcttaattgccatatatgctccttctctataaaacttatcatattctaaatagcaaaaacagtatgttactattatttccacttcacttgctctccagtgggtatgtaaagagggaaaataaaaaaggaaatggttgtaacaaacgtagccacctaaagccaggaaggacagggccagtaccataagatccatacactcaacacatgaatcaagtagggattgtttttaaaagggatgctataagctacttttttaaaaatcaactttattgaagtataatttacgtgataaatgtatacatttgtccatctcaatctttattgagatgtataacttttctatccacatctctgctaacatttggtattatcagccttttggattttagctattctagtgggtgtatagtgcctcgttgtaattttaatctgcattttcctgagaataatgtttaacatttgtgctaaattttgattatacatatacatatttttcaattgtaacaatgtaataatctctggcaaatatctttattataacttttatttctgtatttctatattattttatgaggaatattatacaatttgaacactacaagccacagaaaatgatcagtttatggaactaagtccgacttccaggtaaaacgtaactatggtatggtatttacagtttgtgttgactaaaataagctcccggctgccagatggagctataaggttgccacctctactgccaccatctggtaacattaaaaacaaataaaaatatagaaactatacaattctgggttagccaaagtcaaatttccaacacaactctttctcacgcacagatctttgaaactatagaatgcattcaaactgatttgttctttagttttcgttacttttaaataaactatattacaaaagtgtcaaatagcaaaatattttaattttctcaaattcagggaagatgctttatgacgtacctgcttttcgatttgttccaagacctttggcaaattactttagaactccataggtatcttgaggataactgaaccttttcctaacttaaatcatagactgccagacggaaaaaaaatgtcctcgatgtttttagtctcttactgcacaatgtcaagatatcagctgggttatacaatagttgccctctgcatactcacaaatgttaactccagtccttttttgtcttccctccccgcctaagaagctaccaggtcacatgctggcggatacgcagtggcggaaacctagcggtgacagggaaggacagccctctgcctactgatctgcaggtttctcctccagtttgctcttacaccggggtcctccgctcggaccttagcccattcatttgatgattctctcccagttcgttcttccactgggtcccttgctcagcactacccaaaataaccaccagctcagcgccggctgcaccgccgctcccccgcccccgcccccgcccccgcccccgcccggtggggctgcacctgccgaggccccggctcggctccgcgatcacggtcgcggcccccggggttcccgaggggcttctgcgcaccgaggcaggcgggactgagcggcactctgaacgggctcccctcttaatgtcccctcgcgcctgagcagctccggtcccgccggcgcagggtgcgggtacccgggccatgccggcccagagaccgccgcccccggtaccgctgcccactcgaagcccctggacgaccccgccgcttaccggcttcggcccgtggggcgcccggtagaagaggcgtgcggtccgtgctctcctcgccatcgttccgggccaggtctcgaaccggagacctcatgacgcctacgtgagcaggtgtactcgccacctggcagagaagggagcgccggcccgacagcccgaagcccccgggccgagctggctggaccgggcggggcgggggcgatgacaccgccccgcggccac

SEQ ID NO: 242 - DNA, 307019 bp, Homo sapiens
  source 1..307019: mol_type = genomic DNA
aagaatttcataattatcttgtttaatctctttttttttttcacacttgactttcaggtcaacttttgaatctcattgtacagatgagaaaattgaggctcagaaggaagtgacttgtgcaaggtcatacagcaaaccagatgctaacgcagaataagaggcgccctaggatcctgcctggtgccctgcagtgcccgaccatctgcttagtaaaacctactgcttgctgaagttcctgcacatccaaccagcacacctaacgcaaagtatgacttctttgtggaagttaatgattaaaacctagtctgatctaaagcatcttatccatggttactaattaagccaatttcagtgacagaaagcatttcaaacagaacagtgttctcttaagctaaatctataggcctcaaattatggtggcataaactgtacaattatgatattttgagtacacttaaaatattttataatacaatacattaacctctgtagctttacattttctcttcattgcatgccacatgttgggccctgataaaatggttttataacttttgggggagggctttaactaaaataacttcatgtagtgtttgagcgaactaggtaataaaatctgtttgctgtattcgctgtctccagatagggctgtaattacaccacatgaggaagaaaggtagctgagtttcaatctagatcatttatgtaaactcagccttcttgtcaacggtgttctcaaattgcatgagtgcaaacctcaaaaatcatctcctatgaaccacacagagacagtgtccgattgcaggcctgtgagattgcttatattctttctgtaattggatgtctgtggttcaagaccaaaatttgacattctgaggttaaaagaacactctcaccaatgaattccctagtacaaaaattctgtttctgaaactcgtaaaaattaaagtatgccttaaaccaaagtattacaaatgaatacatttcacttgaaaaaaagctcctttttccttaaagaaaaaaaaaatttggttctttgaaatgtgtttgaataaaaaaactgatcttcaggaaagaaaaacagactattcctaatataaccaatttaacatttgataacattttaatctcctacttcaagtatttggcaacttttcggcaatttctccaaaaagacattataaaaaccataaagcacaaagtatattcatactgcattataaatccagagacatgaggccaggtgcagtggctcaagcctctaatcccagcactttgggaggccgaggcaggcggatcacctgaggtcaggagttcgagactagcctgaccaacatagtgaaaccccatctctactaaaaatacaaaattagccaggcgtggtggcaggtgcctgtaattccagctactcgggaggctgaggcaggagaatcacttgaacccaggaggcggaggttgcagtgagtcaaaactgcaccattgcactccagcctgggcaacaagagcaaaactacatctaaaaaaaaaataataataatccagagacataattacaagccaacaaataaaacatatttttctcaatccattgaactactctccattatgacaaattggtcactagtttttgattagacaatcctccctggttggtattgagagcatttctcttgacacctgcagcttccaacttgctttgtcctctctagcaggaaaaaccacaggccaccgccctggcgccatccctggctcggtccaatcaataaggacttatttcctgtccatttgctgaggtcacaggagcgaatctcattaattatttctgcgactgcagcctcaagtgtgcttctggcgtgacaagtgaaaactgcttgacctttttttcttctaattttgtttgtagcagttccaaaaagaaagcagaactcatttagcaatgtgataaaaggaaggaaaaatgcatatgttttaaaagtcattaacgcatcgtgaaagcgctcccaatcaacctcattccctaggattttcagctaactaacaatagtgtctttttaatttgatgtcatgaaaatctggtcacagcaaacacaatgttttctaaagcagatctggcctccgagggaggaaagctctccagggcctccagtgccttgtttccatggtaacgacacaggtcaatagctgaagtcacacctttgccagctttgattctttctcgcaactgttaagaaacaaatgcatgataaaagtcagttttaaaggtacacagtaagcaccacaattaaattggggaggggagatggaaaacaaagaaagggagaaatagtatagattgagtatttctgctacgttattttctggaaaagaggacatcatttcccagtgatcttgaggcactcattccctaaggctgcttggtgtctgtgctccagagcagcacaataggttccaatcagcttaattacagctcctcctgactcccatcccttaatatcttgaaatgtgccatgctgggggatggcagtaagaaggcggagggcatttacatctctggcattttgaattcagcagcctgatattcttcccttttttttttttttttttaaagagatggagtctcgctctgtcgcccaggatggagtgcagtggtgcgatctcggctcactgcaacctccgcctcctgggtttaagcaattctcctgcctcagcctcccacatagctgggactacaggcatgcgccaccacacccatctaatttttgtattttttagtagagacagcgttttgccatgttggccaggctggtctcgaactcctgacctcaagtgatccacctgcctaggctgcccaaagtgctgggattacaggtgtgagccaccgcacctggccagcagcctgatattcttatgtgaggaaggcttcactaatatcttagttaataactttttttttaacaccatatgttgacacaatagtccatatgaaaattcaagaaagacacatagtattagatctgaatgttactttttttttttttttttgagacggagtctcactctgttgccaggctggagtgcagtggcacaatctctgctcacagcaaccttcgcctctcgggttcaagcgattatcctgcctcagcctcctaagtagctgggactacaggtgtgcaccaccacgcccaggtaacttttgtatttttggtagagaaggggtttcgccatgttggccaggctggtctggatctcttgacctcgtgatccccctgccttagcctcccaaaaagctgggattacaggcatgagccaccttgcccggccttttttttttttttttttttttttttttttgagacaaagtttcgctctgtcatccaggctggagtgcagtggcatgatcttgtctcattgcaacctccgcctcccggattcaagcaattcttctgcctcagccacctgagtagctgggattacaggcgcctgccaccacacctggctaattttggtatttttggtagagatggggttttgccatgttggccaggctggtctccgtctccagacctcaggcaatccgcctgcctcagccttccaaaatgctaggattacaggcgtaagccactgtgcccggcctgaatgcttttttttttttttttttcctgagatggagtctcgctctgtcacccaggctgggatgcagctatctcagctcactgcaagctctgccttccaggttcacaccattctcctgcctcagcctcccgagtagctgggactacaggtacccaccaccatgcccggctaattttttgtatttttagtacagacagggtttcaccgtgttagccaggatggtctccatctcctgaccttgtgatccgcccacctcggcctcccaaagtgctgggattacaggcgtgagccaccatgcctggccagtctggctaattctctaagtcagaaacccagacgtcttcattccccacatccggttaggcacaggggcagtctcagggttgctcattcacagctgaactttctggctcccagagattgggtgtagccaggtgacaagttctggtctatgagttgtgaatgagggatgtcactttgtggctgcagcatttaactgtcctgtgagtccttagagagctttccctcttgcacagctaccagcccacactggagatgctccttggcctggatccctgagtgactgtaatgagcaccacagtgcctcgcccacctgtggcagccgaggttgtgaaattatctgtagccattttgactgataacaatgaatcccagtctttctatctcttcagagctctcaagtttatcctctactcctcattcccattgccactacattagttcaggccatcatcatctctcacctcagttagtttttgcaatcacttcctaaagagtcttcccaccaccaggtctgcacccctggactccatctactatgctgccaaggagatcttaataaaatgcaaagacaatcttgcttaaacccttccaatagccttaagagaaaagtctaagctctttcatgaggcatttaagtcccttgccaagctagctcttgcttggcctcacttttccccccttttcctcctttatttatttatgtattttttgagacagagtcttgctctgtcacccaggctggagcgcagtggtgtgatcttggctcactgcaacttccagttccccggctcaagtgatctttccacctcagccacccgggtagctgggaagacaggcatgcaccactatccttgtttaattttaaaaactttttgtagagatgaagtctcactatattgcccaagctaatctcaaactcctgggctcaagagatcctcctgcctcagcctcccaaaccttctcccctttaattataggggaaccaactgcagttctcagaggtaacctgatctaccatctccccctggggctgtctcccccaccccaacaagctccccaaattccacctgggtggaatgcactgagctaggaagatggccctaaggagctagttgctcctcttcctctgggtacctggagtactccctgtgcacatctggagtagtgtattgttttagcgtttttgtttttttttttagacagagtctccctctatcacccaggctggagtgcaatggcgcgatcttggctcactgcaacctctgcctcccaggttcaggcgattctcctgcctcagcctcccaagtagctgggattacaggcacccgccaccacgcctggctaatttttttgtatttttagtagagacggggtttcaccatgttgttcaggctggtctcgaactcctgacctcgtgatctgcctgcctcggcctcccaaagtgctgggattacaggcatgagccactgcgcccgacttagtgttgtattttaattctccattcacttatctatgacttcatgagacttcaaggtccttactgtataatgcatgaaacatgaatgaataaaataaataagctgatttattcctctaattatacagtcaagagaacagaggtccagagaaactcagtgactcaagatcacagatggaggcaggcagagtagagatcagaagccaggttttctttcttttttttttttttttcgagacagagtcttactctgttgcccaggctggagtgcagtggcgcgattgtggctcactgcaacctccacctctcgggttcaagcatttctctgcgtcagcctcccgagtagctgggattacaggcgcctaccactacacctggctaatttttttatttttagtggagacggggtttctccatcttggccaggctggtctcgaactcctgacctcaggtgatctgcccacctcagcctcccaaagtgctggggttacaggcgtgagccactgtgctccgccagaggccaggttttctaatgccttgtccagtggcacttaatactaaactccatcagattctcagcacttcacagatatttccacactgcatatagcctttgggaactgttctagcctaggtttccttggtctcttgccaatcattgaatgcacaaaggcactaaaatggtgctgggtatcagaagcagccagattcaaactcctatcctagctttataatcttatggaaaccatttaactgttttcttttttttttcctttgagatggagattcactcttgtcgcctagattggagtgcaatggtgcaacctcgactcactgaaacctccacctcccaggttcaagcaattctcctgtctcagcctcccaagtagctgggattacaggtgcccaccgccacacccagtcaatttttatatttttagtagagacagggtttcaccacattggtcaggctggtcttgaactcctgacctcaggtgatctgcccaccttagcctcccaaagtgctgagattacaggcgtgagccactgcgcccggccttaactgttctcagttctaagtggggataatataagtcccttgtcggactgctggggggactacataacactgcacagagtgcctgatagtgcctaaatcacaatagatgctcggatgacttagtttcccttcattaagcccatagccattaccaagaaagccatcccacccaccaagatcaagtctattttgacgtgatatacaataacctcaaagctaactggacttggatcagagcagtcttaagggaaggaaggaaggaaggagggagggagggaggcggaagggagggagggaaggaggaaggaaggaaggaagaagggaaagaagggagggagggagggaggaagggagagaaagcaagcaagctaccctattttctttcttttctttttttttttttttgagatggagtcttgctctgttgcccaggctggaatgcagtggcgcgatcttggctcactgctacctccgcctcccgggttcaagcgattttcctgcctcagcctcccgagtagctgggactacaggcacgtgccaccatgcccggctaattttttgtatttttttagtagaggtggggtttcaccgtgttagccaggatggtcttgatctcctgaccttgcgatccacccacctcggcctcccaaagtgctgggattacaggcgtgagccactgcgctgggccaagctcccctattttcattatctcttctccaaattgatattaggcagaccaacattctcctcctattctagacttctaggttagcacctttaggtatgtaaatgtctgcatgactagataagatgtttaatttatgagtattaattgagtatttactatatgtaaagagtagaataagccttctttgctttgtggatcaagagttaattaagggatggctgggtgcggtggctcactcctgtaattccagcactttgggaggccttggagggcggatcacttgaggtcaggagttcgagatcagactggccaatatggtaaaactccatctctactaaaaatacaaaaattagctgggcatggtgccgtgcacctgtagtcccagctacttgggaggctgaggcaggagaattgcttgaactcaggaagtggaggttacagtgggccaaagtcgcgccattgcaatccagcctgggggctgcagtgcgactctgtctcaaaaaacaaacaaaacaaaaacaaaaacaaaaaaacacaaagaacaagagttaattaagggtaaactgtgaaaagcagcaaaaccagggcacaaatgtaggactacagctattgagagaaatgagagatcaactttaactgaaagagattctaaaaggccttcctctgtcacccagactggagtgcagtggtggatcatgatggttcactgtagcctctacctcctgtgcacaagcaatcctcccatctcagcccccaagtacctgggactacagggacctgccaccacacccagctaatttaaattttttttttttgtagagacacattctcactatattgctcaagatggttttaaactcctggcctcaaatgatcctcctgcccctcgcctcccaaagtgctgggattacaggcgtgtgtcacctcggccagttgatgtcttgtaaatgctgataaatagatatgggcttgggagtagcaaggaaattgtagggaaagaaaactgtttgagcaaaggcacaaagggggccaaagtgtgcagagtgtccagggaatgaaaacagatcagtatgaaacagcttgctgtttcttggctcactgcaacctgtgcctcccaagttcaagagattctcctgcctcagcctcctgagtggctgggattacaggcgtgccaccatgcccagctaattttgtatttttagtagagatggggtttctccatgttggtcaggctggtctcgaactcctgacctcaggtgatctgcccacctcggcctccaaaagtgctgggattacaggtgtgagccactgcgcatggccaatttttgtatttttttaatagagatgtgttttcacaatttttgttaggttgatatcaaactcctgagctcaagtgatccacccacctcggcctcccaaagtgctgggattacaggcgtgagccaccactcccagcctaggctaagaaatttgtactttttggccgggcgcggtggctcatgcctgtaatcccagaactttgggaagctgaggcgggcggatcacgaggtcgggagatcgagaccatcctggctaacacagagaaaccccgtctctactaaaaatacaaaaaattagccaggcgtggtgccgggcgcctgtagtcccagctactgtggaggctgaggcaggagaatggcgtgaccccgggaggtggagcttgcagtgagccgagattgtgccactgcactccaacctgggtgacagagcgagactccgtctcaggaaaaaaaaaaaaaaaaagaaatttgtacttttaaaaagtgttcaatttgtattataaattattttcaaagtacagaaaacttgaaccatggccctaggctaaatttgaccctgtgttctcataaataaagttttgttggggaataaccacatccattcatgtgagcattatccatgactccttttgtgctataaaggcagagttgcagagttgcagagttgcctgagaggctgtatggccacaaagtgttaaatattcacagtttggcctttacagaaaaagtctgctgactcaagtactagtgctatgaatgaccatagattctctacctagattcaacaatcgcaacaattgttagtattttgccatttttgttctatctatatgtgtgtctgtgtgtgtgttttctgatccatttgaaagtaaaccgccgatagtgatatgctagtaaattagttctcttgggggacaaaagcctgcatttgcagatttttgtggtataaatactcccattatggctgatttcaaactgccaagggtggtggggtcacacaattcttgaagatttaataatagcctgtgagtcgttaggacttggtttgggcacatcattggctgcaggatgcttcacccttgttttgacatgcatctctgaagaacattgtcctacataatcacaatactattgtcacagctaggaaagctaactagaaaaactaattagagaattcccggccgggcgcagtggctcacgcctgtaatcccagcacttgggaggccatgggggatggatcacttgaggccaggagtgagaccagcctggccaacatggtgtaaccccatctctactaaaaacaaaaattagcccggtatggtggcgtgcacctgtaatcccagctacttgggagactgaggcaggagaattgcttgaacacgagaggtggaggttgcagtaagccaagatcatgccactgcacttcagcctgggtgacagagtgagtgagaccatctcaaaaaaaaaaaaaaaaaaaaaaggagagagcattccctatttattttttgtttgttcaagtttccaatttttaaaaatttacactttttctttttattttgtcaagaattccctaatttttttttttttttgagatggagtctcactctgccactcaggctagagtgcagtggcgcaatctcagctctgcacctctgcctcctgggttcaagcaattctcctgcctcagcctcccgagtagctgggattacaggcatgtgccaccacacccgactaatttatgtatttttagtagagttggggtttcaccagattggccaggatggtctcgaactcttgacctcaacagatccatctgccttggcctcccaaagtgctgggattacaggcatgagccactgtgcccagccccgataattctggcacagggctgaattatctaacatttagtccaggtgtaaatttctccaattggttccagaatggcttttatttaaccatatttttaaactatgataaatccagttcataaatcacatttgtttgttatgacactttaatcttttttctgctatgacattgtcattttgaaagaccagcctgcactccagaatgttttacattctacattcccctgactgtttcatttagtttgttcctctatgagctttattcagccaggctaaactaaatatctgatgatagctaacagggtatttaatactatgataaaagggtaattcagattagggcaaaagagcaaccaggaggacatcacagtcctagaggatttaatttctcatacctgatgactattttactttagtcaatactcaactccagacttgggctcacagggctttgcataccaaggaggaacctgatagctttcatgtgtaaaatgcccaccagtaatgacttatcagtaatataatccttcatgaaaggtattattcctcactgacatctgtaaacactcctgctagctaaacataaactactgactccaaggaaatcctttagttatgataaaccataaatgaaactcatttttactgcaaactagaatgggcaataggtctatcttgaaaagaatgatcttgttctttttttttttttcttttttgagacggagtcttgctctgtcacccaggctggagtgcagtggcatggtttcggctcactgaagcctctgtctcccgggttccagcgattctcctgcctcagcctcctgggtaggtgggattacaggtgcatgccaccacacgcagctaatttttgtatttttagtagagacagggtttcaccacgttggccaggctggtcttgaactcctgacctcaggtgatccgtccacctcggcctcccaaagtgctgggatcacaggtgtgagccatcacgcccagctgatcttgttcttttttaaataaacgtgacaacagatacattaagctggggttcctaaacttgcctggccgtaagactcatgtggggaactttaaaatgcagatgcctaggcctctagccctggagatagagtctatcaggactgaaaaaaagggttcttaggtcattccagtgattagccagatttgggagtacctactcattggggcatgtattttgagtcactgtattttaagactgttgttttgggtttatacttaaaaaaaattttttttttaattatactttaagttctagggtacctgtgcacaacgtgcaggtttgttacatatgtatacatgtgccatgttggtgtgctgcatccactaactcgtcatttacattaggtataattcctaatgctatccctccccacttcccccaccccacgacaggccctggtgtgtgatgttccccttcctgtgtccaggtgttctcattgttcaattaccacctaccagtgagaacatgcagtgtttggtttttcatccttgtgacagtttgctgagaatgacggtttccggtttcatccatgtccctacacaggacatgaactcatcattttttatggctgcatagtattccatggtgtataggtgccacattttatcaatccagtctatcattgatggacatttgggttggttccaagtctttgctattgtgaatagtgccgcaataaacatacgtgtgcatgtgtctttatagcagcatgatttgtaatcctttgggtatatacccagtaatgggatggctgggtcaaatggtatttctagttctagatccttgaggaatcgccacactgtcttccacaatggttgaactagtttacagttccatcaacagtgtcaaagtgttcctatttctccacatcctctccagcacctgttgtttcctgacttcttaatgatcgccattctaactggtgtgagatggtatctcattgtggttttgatttgcatttctctgatggccagtgatgatgagcattttttcatgtgtctattggctgcataaatgtcttcttttgagtttccgtctgttcatatccttcgcccactttttgatggggttgtttttttcttgtaaatttgtttgagttctttgtagattctggatattagccctttgtcagatgagtagattggaaaaattttctcccattctgtcggttgcccgttcactctgatggtagtttcttttgctgtgcagaagctctttagtttaattagatcccatttgtcaattttggcttttgttgccattgcttttggtgttttagacatgaagtccttgcccgtgcctatgtcctgaatggcattgcctaggttttcttctagggtttttatggttttaggtctaacatttaaatctttaatccatcttgaattaatttttgtataaagtgtgaggaagggatccagtttcagctttctacatatggctagccagttttcccagcaccatttattaaatagggaatcctttacccatttcttggttttgtcaggtttgtcaaagatcagatggttgtagatgtgtggtattatttctgagggctctgttctgttccattggtctgtatctctgttttggtaccagtaccatgctgttttggttactttagccttgtagtatagtttgaaatcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcttcttttatttcgttgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgcactttgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagtttccaacgggaatgcttccagttttgcccattcagtatgatattggctgtgggtttgtcataaatagctcttattattttgagatatgtcccatcaatacctaatttattgagagtttttttttttttttttttttgagatggagtctcactctgtcgcccaggctggagtgcagtggcgtgatctcggctcactgcaaactccgcctcctgggttcacgccattctcctgcctcagtctcctgagtagctgggactacaggcgcctgccaccacgcctggctatttttttgtatttttagtagagacggggtttcaccgtgttatccaggatggtctcgatctcctgacctcgtgatccgcccgcctcggcctcccaaagtgctgggattataggcgtgagccaccatgcccggcctttattgagagtttttagcatgaaggctgttgaattttctcaaaggccttttctgcatctattgagataatcatgtggtttttgtctttggttctgtttatatgctggattatgtttattgatttgcatatgttgaaccagccttgcatcccagggaagaagcccacttgatcatggtggataagctttttgatgtgctgctggatttggtttgccagtattttattgaggatttttgcatcaatgttcatcagggatattggtctaaaattctctttttttgttgtctctctaccaggctttggtatcaggataatgctggcctcataaaatgagttagggaggattccctctttttctattcattggaatagtttcagaaggaatggtatcaactcctccttgtacctctggtagaatttggctgtgaatccatctggtcctggacttttttttggttggtaggctattaattatcgcctcaatttcagagcctgttattggtctattcagtgattcaacttcttcctggtttagtcttgggagggtgtatgtgtccaggaatttatgcatttcttctagattttctagtttatttgcatagaggtgtttatagtattctctgatggtagtttgtatttctgtgggatcagtggtgatattccctttatcattttttattgcgtctatttgattcttctctcttttcttctttattagtcttgctagtggtctatcaattttgttgatcttttcaaaaaactagctcctggattcattgattttttgaagggtttttgtgtctctgtctccttcagttctgctctgatcttagttatttcttgccttctgctagcttttgaatgtgtttgctcttgcttctctagttcttttaattgtgatgttagggtgtcaatttgagatcttttctgctttctcttgtgggcatttagtgctataaatttccttctacacactgctttaaatgtgtcccagatattctggtatgttgtgtctttgttctcattggtttcaaagaacatatttatttctgccttcatttcgttatgtacccagtagtcattcaggagcaggttgttcagcttccatgtagttgagcagttttgggtgagtttcttaatcctgagctctagtttgattgcactgtggtctgagagacagtttgttataatttctgttcttttatatttgctgaggagtgctttacttccaactatgtggtcaattttggattggtgtggtgtggtgctgaaaagaatgtatattctgttgatctggggtggagagttctgtagatgtctattaggtccgcttggtgcagagctgagttcaattcctggatatccttattgactttctgtcttgttgatctgtctaatgttaacagtggggtggtaaagtctcccattattattgtgtgggagtctaagtctctttgtaggtctctaaggacttgctttatgaatctgggtgctcctgtattgggtgcatatatatttaggagagttagctcttcttgttgaaatgatccctttaccattatgtaatggccttctttgtctcttttgatctttgttggtttaaagtctgttttatcagagactaggattgcaacccctgccttttttgttttccatttgcttggtagatcttcctccatccctttattttgagtccatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttactggatgcagtttcttcctagcctcgatggtctttacaatttgacatgtttttgcagtggctggtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattgccccccactctctcctggcttgtagggtttctgccgagagatccgctgttagtctgatgggcttccctttgtgggtaacccgacctttctctctggctgcccttaacattttttccttcatttcaactttggtgaatctgacaattatgcgtcttggagttgctcttctcgaggagtatctttgtggcgttctctgtatttcctgaatttgaatgctggcctgcctcgctaggttggggaagttctcctggataatatcctgcagagtgttttccaacttggttccattttccctgtcactttcaggtacaccaatcagacgtagatttggtcttttcacatagtcccatatttctcggaggctttgtttgtttatttttcctcttttttctctaaacttctcttctcgcttcatttcattcatttgatcttcaatcacttgataccctttcttccacttgatcgagtcggctactgaagcttgtgcattcgtcacgtagttcttgtgccatggttttcagctccatcaggtcatttaaggacttctctacactggttattctagttagccattcgtctaatctttttttaaggtttttagcttctttgtgatgcgttcaagcttcctcctttagctcggagaagtctgatcatctgaagccttcttctctcaactcgtcaaagtcattctccatccagcgttgttccattgctgacgaggagatgcattcctttggagggggagaggcgctctgatttttagaattttcagcttttctgctctgttttttccccatctttgtggttttatctacatttggtctttgatgatggtgatgtacaggtggggttttggtgtggatgtcctttctgtttgttagttttccttctaacagtcaggaccctcagctgcaggtctgttggagtttgctggaggtccactccagaccctgtttgcctgggtatcagcagcagaggttgcagaacagcgaatattggtgaacagcaaatgttgctgcctggttgttcctctggaagccttgtctcagaggggtacccggccgtgtgaggtgtcagtctgcccctactgggggatgcctcccagttaggctacttgggggtcagggacccacttgaggaggcagtctgtccattctcagatctccaactctgtgctgggagaaccactactctcttcaaagctgtcagacagggacatttaagtctccagaggtttctgctgccttttgtttggctatgccctgccgccagaggtggagtctacagaggcaggcaggtctccttgagcagcggtgggcttcacccagttggagcttcccgctgctttgtttacctactcaagcctcagcaatggtgggcgcccctccaccagccttgttgctgccttgcagttcaatctcagactgctgtgctagcaatgagcgaggttccaagggcgtgggatcctctgagccaggcacgggatataatctcctagtgtgccgtttgctaagaccactggaaaagtgcaggattagggtgggagtgacctgattttccagttgccatctgtcacagcttcgcttggctcggaaagggaattccctgaccccttgcacttcctgggtgaggcaatgccgcaccctgcttcagctcacgctcggtgcactgcacccactgtctgacaagccccagtgagatgaacccggtacctcagttggaaatgcagaaatcacccgtcttctgcattgctcacgctgggagctgtagactggagctgttcttattcggccatcttggaaccacccccccccccccacttttttttttctgagacagcctcactctgacacccaggctggatgcagtggcacaatctcggctcactgcaacctccacctcccaggttcaagcaattctcttgcctcagcctcctgggtagctgggattacaggcatgtgccatgatgcctggctaatttttgcacttttagtagagataaggtttcaccatgttggccaggctggtgtcgaactcctgacctcaagtgatcctcccacctcagcctcccaaagtgctgggattacaggcatgagccactgcacccagccaggtttatactattctaaccatacttcaactggttgtctttgcaacaatcaaattaaaaccaacaagcgtttattggacacctatataacctaggcatttggtatatgctggaaatacagagaggaacacagttgctgcctcccaggaccacctgttagagaggtagtcacaggcctgtagaacagagagggttaagtagaacagtgaaggaatggacccatgaccttggttcttttttgttctttttttaaatacgcctttattttggagacaggtctcactctgtcacctaggctgaagtgcagtagcaagatcatagttcactgtagcctcaacctcttgggcttgagccatcctctcactttagcctcctgagtagctggcactacaggcacgtgccaccatgcctggctaatttttgtattttttgtagagatgggttttgccatgttgcccagaggctgatcttaaactcctgggatcaaatgatcctcctgcctcagcctcccaaagtgctaggtaacaggtgtgaaccatcacaaccgtccatgatcttggttctaatagccatagataaaagaccacaatttttttcaagttctttttttttctttttgagacagcgtctcactccatcacctaggctggagtgcagtggtatgatcaaagctcaccacagcctcaaattccagcctcaagcaatcttcccaccttagccttccgagtagctagggctataggcatgcatcaccatgcctggctaatttatttatttttattctgtggacatgagcatggcgggtggtctcatcatgttgcccaggctggtcttgaattcctggccttaagtgatctttccatctcggcctcccaaggagctgggattacaggcgtgaggcactgcactcagcctaaaaaaggcatttccattcctgccttcatctacattttgaatgggcaaagtccaagctgatgcatagaaagaactttccaaatcttcaagcccttatggcttgaagatcgctgtagtcataaacagcacaataaatacgaaaggtgaattaacagtcagtgtttaatttctctgatatagcactttagggcactaatataattaaatctctaattaagtcaactaaataattgtataagtgcagtatcacctgaaataaattaagtccaaatcccctgctaggggatccaattaaagatattaacaaagagagaagaggatacaaagtacttaaaattaagtgcattattatttaacatttattaaacaccttttgaatgatacatgttgctcttacataaaagaccctcttgagaaaatcactgtatgtctctgaaaactatgtagttcaaaagttctaaaagttcttttaaaatattaaagagaaggccccggcatgggttctgagtagtcttaggagaagtggaggcagcagccacttctgcccaaggaaactagagaaagactttaagacttaggagaggccaggaatggtggctcacacctgtaatcctagcactttgggaggctgaggcaggagaatcacttgaacctgggaggcagaggttgcagtgagctgacattgcgccattgcacttgagtcaaggcaacaagagtgaaactccgtctcaaaatacataaataaataataattttaaaaaagaggacaaaggagcattctgaaacacagaccagtgaatttatggagaatttatggcaaaacttcaaaaagggttgttaaacagatggtttgtgggctctagaaaaaaaggcaatggtggtggcagccccaggataagtgggtcacaataagcaagtcataataaaacacacacacacacattctttttttttttcttcttcttttttttttaaaatgtggccacttggctggtagcttcagaaataggatagagtggctgggcacggcagctcacgcttgaaatcccagcactttgggaggccgaggcaggcagatcacgaggtcaggagttcgagaccagcctggccaacatggtgaaaccccttccctactaaaaatacaaaaattagctgggtgtggtggcgtgcacctgttgtcccagctactggggaggctgaggcgggagaatcgcttgaacccaggaggcggaagttgcagtgacctgagattgtgccactgcactccaacctggcaacagagcgagactctgtctcaaaaaaaaaaaaaaaagatagagtaactttggatttttgaagtttagtccttcatgaataaggcagagaaacagggtacaggtcacagtatggtaagatagatttgaacatgtaaaataattattcctaggaaatgtttagtagtggatttatattgaacaggaaaacaggccaggcgcggtggctcacagctgtaatcccagcattttgggaggccgaggcgggcggatcacctgaggtcacgagattgagaccatcctcgccaacatggtgaaaccctgtctctactaaaaatacaaaaattagttgggcgtggtggtgcacacctgtagtcccagctactcgggaggctgaggcaggagaattgcttcaacctgggaagcagaggttgcagtgagccgagatcgcgccactgcactccagcctggtgatggaatgagactctgtctcaaaaaaaaaaaaaaaaaaaaaaaaacgcttagaacaggaaagcagtctctagtgtcatgctaccagaacttaatgcttggtttcttcttcttatcacgtttctatgcattacttgaatgaagatgaagaagaaatgcatattaaattttaattttcagatgtcacacagccaagagagataggtaacacatggatagtatcaaaattttaacggtattgacatgttgaacaaaagactgatagtagccagtaaaatctaacagggataattatatagttgtatatttaggtttcaaaaattaattgtaaaagtataagctgcaatttggcagtgactcatgaaaaatgttgagaatctttaataaccacagtcttggtatcagccaaggctgtgatgtaggtacaaaaaaatgcaaatgcaaactttggcagcatcagcaggtgtacatgtccaaaacacaggcaggaatggtctcacagcacacggacggtcaactaatgtttagaaaactattttcagtcctgggggccatgagtcaagaggggcactggcatgatagattgggtccagtattaggatgaagaaggatttggaaacatgtcacctagggaatgtttaacctggaggaagggaggatataaaagccatcttcaaatatctgaagtaattaaatggaagaaggaacagtcctgttctatgtgcttcaggggacagaacaaacagcaacaaggtaaagtttctcggaagaagattccacttataaataagaaaagaaccttcaaatgactagagttgtctaacaacagaatgattatttttgacaagctgtgggttccctattattggaagccttcagtgactggatgaccacatgtaggagaaaatatgactgaaactcttcgccagtgtgaaagataggacgacgctgcctctaaaggtctacccaagcccaagattctagctgatagtgcttaactgaaaggtcttgacagcttctgagtggcaagacttggtacaaaaggaaaagctacagttttctaatacaataaactgtgaaatgcattgcaaacaacataaaagcattcctttttactcagagttagaaattatttgcaagagtctataggaaaaaaaattcaccgatcttaattaaacatcttaatctgacaaaactagaaagagacaaagagaattttaaatagatttctcaatcatatgagattcacatgcaaaaatacagtaagaatagtagtgtttcccaatattagaaaagcaataataataacagcaatgacaataaagacaatctcatatatagtacttactgtgtgcccagcactgttctaagatctctctcttggccaggtgtggtggttcacgccaggaatcccagcactttgggaggccaaggtgggtggatcatgacgtcaggagttcaagaccagcctggccaacatggtgaaacctgtttctactaaaaatacaaaaattagccaggcatgctggcacacgcctgtaatcccagctactcgggaggctgaggcaggagaattgcttgaacctgggaggtggaggttgcagtgagctgagatggtgccattgcactccagcctgggcgacagagtgagactccatctcaggaaaaaaaaaaaaaaagatctctctctctctcgctctatctgtatctatacctatatctatcttctaccctcacaacagccctacgaggtagatgctactattattttcattttacaaaggaacaaatttaggtaagagcaagttgtccaaagtaacacagatgataagtgctggagtcaagatgagttcttgttcttaaccaatatgctatagtccctttctttcactcttaaacaaaccagaaagcattacaatttcatttgagaacataacacatacctatatcgctaatgtcctttgcatgcctatgtacaaggacagattttttaaaagatacatatcacagattagaaaaaaaatacctccagtcaaatagcttatgataaagccatatttatagagattgcagaaaattgaagccattatttaattatgtacctctactgcaacacatatatattttccaccaacctaaaaatgccatatggttgtagaacaaatgtcagtagaaattggaggtagaaattttccacattttctgctaagaaaaaggtcatgcatatctcaattgattaagtatattcttctggtcatacttttttgttgttgttgttaaacctaaaggcactgagcaagacaggtattatctcatccgccactgagtcacaaaacaaaactagtatatttttacttaaatccttaactaaccaaaacttatttttattaaaattatcaaccaaaggcactcactgcagtagtggtatttgtggtttcatgcagtgacaataccaaatattgccccaggttattttcactgcttttatttatttatttatttatttattgagatagagtctcattctgtctcccaggctggaatgcaatggcacaatctcagctcactgcaaactccacctctcgggttcaagtgattcttctgcctcagcctccccagtagctgggattataggtaagcgccaccacactcagctaatttttgtatttttagtagagacggggtttcaccatgttggccaggctgatctcaaactcccgacctcaggtgatctgccggcctcagtcttccaaagtactgggattacaggttgagcccctgcgcccggccaaaacatgtctatttttgaaaaatgaattcccaaatcatattgactatttaaaatgtattctattcccccttaacacacacacacacatacacacacacacacacacacacacacacaaatataaaagcatgtttagtatagtttttcttgccctgtcctccacgtttatcaattttactgttttctaatttaaaactgtatggctattatgcttagtctggatggtatgcagcctcctgttgggagtgagacttcagaacttatttcaaggctcaacctctctgctaagtacgtttgtgagttcacgctgtggcctgccatccacaaagagctgaacacaacgcaacagctcatttcgtacaaattatcataactgaacagatataaccatactactgtatatgtataaatactcctaaaccatatggtagggatacatttatatgatataaaatatatctacatcatataaacatgtttatatggtttagaggtatttatatatagtttaaataattttactggtacacttaaaattgacctaattgttgacagaatggcagagaagaactgagacaaagtagtgcttgctatgtcaaggagtgaaggtcaatttggatgacagagtgagaccctgtctcaaaaaaaaaccaaaaaaacctgcatttcagggtatgagcagacatgcctgctctcaaaatgtaattaaatgagacaaaatggacgaagtaattcttttttttttttctattttctttacatgtatctgctgaaacacgtaatgtaattctttttttttttttttttgggagacagggtctcactctcactcaggctggagtgcagtgttgcaatcttggctcactgcaacctctgcctctcgggttcaagtgattcttgtgcctcagcctcccgagtagctgagattacaggcatgtgccactgtgcctggctaatttttgtatttttagtagagacggggttttgccatgttggtcaggctggtctcaaactcaaactcctgatcccaggtgatccgcccgccttggcttcccaaattgctgggattacaggcgtgagccaccatgcgcagcctgtaattcttaatttataaacttgcatcaacatttgataggtttggcatttgaggttagtaatatagaattatattacatttaggattaatttcacaggaaaagcaatcactgcctcttggttgtcatgtcttccaaaggaatatttggtgatttataaataatcatggatttatccatattctgattcaaagttaatttttaattttagtatcatattccaaagagaaacttaattctacacattgaaattcaaaagcaaaactgggactgtaaagctttttagcaaactctgtaatagaaattcaacaagcaaaacatgtcataggctgtagactgcagcaatgagccactcttgcctgtagcttttttaggagtgaatcaataaatagtaagctctgtaatctcatgacaaatactaagctggttatttaattaaaaagaatactgtgggatgagagcattcacatcatgtaggaatcaaatagtcctgggggtatttgaggaatatataaactatgttaagagtgagtttcggtttctgttattttacttgaatccctatcttacttatacatttcttatatccttctcatgttccaattttcatgtgctttagtatttggatgctgatacctagggaccacttgccccaaactaccactatcatcatccatgtgatcctagattcctagcatcctaaaatacatcctgatataagatgagtttaaaacacatttataatttcacaagaaagcacctcaaacgacagagaaattctatctacatttattaatgaaataaatgtaggcttcagccacgtcttctaggtaggttgcatcagtgtgggggccaatgtatgaggtgaagaatgtatatttactctgtgccatgtaagtgtaatcatatctgcaagattaacagctcttccaaatgtaggaggtctctacgctatggtgttatggaaggtgtatttgttaacttagattgtgcctctttcaagagaatgatgatcagagtttgttttaaatggttattatctataaaactttcttttcaaaagtgaagcatgcttatcagcttaaagtcacaataattattacactggttcagcaaacataaatcctagcacagtcatttattagacaatcacatttctgagaccagaattatgttagattatagactaatacacaccgttttctggatgcttgcaagatcagagcctgaatacaacaacaactttttgtagtatgtctaaagcactttgagaagcaggatggtggtaaagaatacacactgctgctgggcgaagtggctcacatctgtaatcccagcactttgggaggctgaggtgggcggatcacttgaggacaggagttcgaggccagcctggccaacatagtgaaaccctgtctcttaaaaaaaacaaataacaaaagagaatacacattgtgaagtcagcagacctgagtagaatcttgaccctgtgagataattgtgtggacactgttaggttatttgagctcttctctataaaaagaggggattcacagaattcgatagaaccatttgattaaggtgtttagtgtgtgtcttaaacagtgtacgctgcaaagcacgcatacaatggcatgcatcttaaagaaagtacagcacatagaaaggtctacccatttttctgacagctgcacacaaatcttaggaatcaattaaagatacaggttagcataatcttcttagatccaggatagggagatcttccacagggggcaccattgcgctacacactaatcaatcttcagaggtacagctttggttttattatgatttagttaagatccttcttcttctttttttttttagatggagtttcacattgttgcccaggctggagtgcagtggtgtgatctcagctcactgctgcctctgcctcccgggttcaagcgattctcctgcctctgcctcctgaatagctgggattataggtgcccgccattacgcctagctaattattgtatttttagtagagacggggtttcaccatgttggtcaggctggtctcaaactcctggcctcgtgattcgcccgcctcggccttcttacaggagtgagccacagcatccggccttagctaagatctttcatcaagccagaatgtcaaggactcgggggaaaaggacagaatctactcacctacaatctttagtaacatttcacacttcactgagctatgctgcaggtcccatgatctctactgttacctaagtaattctgtttgaaaactgagggacatagccaccttgttatttcaggaaagatggttaagtacattatcagggatcaatactctgatgtggtaagtggggaggctgagtagtgcttggagacactgcataggaaatatagaggaatggcttcagatgtaccaactgaatcaactacagctttctgatggctcaaacagcttcaaatcacaaaaattcttaattcaacacaaaatccgacagcaggattagtgtatgactgtggaaatatgaatctaggtaacgatatcttctaacttactaaaactacgttcagtatctatacagaggtgcctctcttttcactcaaaaaccataattttgggaaacccatgcctctccactatattttatgacaaggaaagagatagtgttcccttcagatccactttaaaacagttttaatggactaaacaggcttttctatagggacagagggctctatcttcgacataaagacatacaggctctcctggtgcacaggtggcttctgacaccacaaactgggagcaataattgaatccagctatcccacagtgcagagcatccacccgcagagccagcctgaagggcatttctagttagctttccagataagactcaaaagattaccccaattgaatctctctgcctcaacccagggggtgagaggcattgaggatgtaatcatttgattaaaaatatacttggggggatataagaggaacaaaggtggaattaaatattccttatgaattagaagaacagaggttaggcaaaaacgcgcagtatcttgggtcatcattcattcattcattcgacagtcagtcaacaaatatttattgggtacctatcctgcaccaggtgctgtagtaggctttcacggtgcaatggtgagcaaactcaagacaccattccatgcttaccgtcaagaactggtcttcatcaacgatctaagcctgacttagcttcctgataaatattagatattatgtagatatgtaatttttaggggtcagtaatacaaaatggtaaattgaagagtgggagagactgccccactaaatattgttatgagctaaataatgtaaacttttacatatatcattttattcatttactttttatttatttatgtatttatatttggagatgatgtctcactctgtctcccaggctggaatgcaggggcgcaataaccgcaacctccatctcccggattcaagcgattctcctgcctcagcctcctcagtagctgggattacaggcatgcaccaccaagcccagctaacttttgtatttttagtagaggtggggtttcaccatgttggtcaggctgggctcgaactcctgacctcaggtaatccacccaccttggcctcccaaagtgctggaattataggtgtgagccaccacacccagccacatataatattttaaaccaagcatcaataaactaggaatatagaatctgaagaaaaataaaagagatttataactgcctatattaaattagtatcagtagtacttggggccgggcgcagtggctcatgcctgtaatcccagcattttgggaggctgaggcgggtaatcacctcccaaaggagttcaagatcagcctagccaacatggtgaaaccccgtctctactaaaaatacaaaatgtagcctggcatggcagtgggcgcctgtaatcccagctacttgggaggctgaggtaggagaattgcttgaacccaggaggtggaggttgcagtaatttaagattgtgccattgcactccagccttggtgacaagagtgaatctctgtctcaaaaaaaaaagaaaagaaaagaaaagaaaaagaaataagaaaaaaaaaagaaagaaaaaaagaaaattatggatggtcgggcaccgtggctcacacctgtaatcccagcactttgggaggctgaggccggtggatcacctgaggtcaggagtttgagatcagcctggccaacatggtgaaaccccatctctactaaaaatacaaaaattagccaggcatggtggtgcacacctgtaatccaagctactcaggaggctgaggcaggagaatcgcttgaacccaggaggtggaggctgcagtgaaccaagattgtgccactgcactccagcctgggtgacagagcaagactctgtctcaaaaaaaaaaaaaaaaaaattatttgggctaactgagagggtggcatgttatatgatgtcataaagatgcttatcattaaaatcatttaataattttattcatgatccacaaaggaatagagattatgataattaaatctgctgatgccactgaggtgtgtgggattgctaacacctcagagaacaagaatctaattttaaaataacattaagaaattagaggaacagataatcaaagcaagatgatagtcactggggacaaatacaaaataacatactgaaagagttaaggagaaaaaagactagcttgatgataggaatgaataatgtcgagagggcaaatgttttgcaaaagaccaaggctaataataaggcacaactctggtttaagatactaactattgcatgtgtgtataatttatttattttatttatgtatttatttatttatttgagacagagtctcactctattgcctgggctggagtgcagtggcacaatctcagctcactgcaacctctgcctcctgggttcaggcgattctcttgcctcagcctcctgagtagctgggactataggtacccgccaccacaccaggctaatttttgtatctgtagtagagacggggttttgccatgttggccaggctggtctcgaactcctgacctcaagtggtctgcccaccttggtttcccaaagtgctgggattacaggcataaaccaccacacccggcctataatttatttttgatataatgtttcacatggtacaaaagcttctataatttactgtaaacagaaactgatcagtgattatttttccatcattaataattgcaatttgaaggagatatgaaatcaaagcagtggttgcaaaaactgacaaactaattgttttgaaaaacagattaaagagaatctactcactattgctgcaaagaaaaacaggtgtctgaaatgtagttgccaagagaaaaataactggtttaatctggttttaaggaaatgaggagtgggggatttaaaatttttggacaggggctggtcatggtggctcacacctgtaatcccagcaccttgggaggccaaggtaggaggatcacttgaccccaggagtttgagaccagcccaggtaatatagtgatacctcttctctacaaaaaaattaaaaaattagctgggtgtggtgacatgcaactgtagtctctgctacttgcaaagctgaggtgggaggatcacttgagcccgggaggtcaatactgcagtgagccataatcatgccactgcactccagcctgggtgacaagcaagactgtctaaaaaaaaaaaaaaaaagttacatagttgcacccataccattatggtattttgatatggatttttttttctttaaattctactataaacgtcttatctaattatattacaagtcccttatggaacaagataggagagggcaatgccaatggctccacaatctccatagttatcactaaaatagaaatcctaaatgctaagacatctttggccaggtgcggtggctcatgcctgtaatctcagtactttgggaggtcgaagcggatggatcacctgaggtcaggagttcgagaccagcctagccaaaatggtgaaaccccatctctactaaaaatataaaaaatagccaggcgtggtggcaggcgcctgtaatcccagctactctggaggctgaggcaagtgaatcacttgagctgggtgcagtggctcacgcctgtaatctcagcactttgggaggccaaggcaggcagatcacgaggtcaggagttggagaccaacctggccaacatggtgaaaccccgtctctaaaaatgcaaaaattagctgggtgcagtggtgcacacctgtagtcgcagctacttgggaggctgaggcaggagaattgcttgaacccgggaagtggaggttgcagtgagctgagatcacgccactggattccagcctgggcaacagagtgagactccatctcaaaaaaaaaagagagaatcacttgaacctgggaggtggaggttgcagtgagccaagattccaccactgcactccagcctgggcaacgagaattaaactctgtctcaaaacaaaacaaaacaaaacaaagcaaagaaaaaatacatctttgcggggctagagaaaatgagagatttagtgcattcagtgatgttgtatggcatattttaccaaaaaagagctaatgtaaagtcccagggtaggagatgcagcatctgcccaagaaaggggtacaggaaagagaaaacacagcaacaactgttttctaaatgtgccaatgtgaaaaagtctcagagccagtttgctagggtcatgggaaggaactagcagcaaaaattgactaccaaaaataaataaataaacgaataaaggagtctggctttgtcagtaaaaaaagaacaatactatatacaaaaaatttctatattcaaggctcaaaaaagaaaattctggactcaatatgcagaaaaatggctgaagcatctatgtgtaataagaagaaatgactaaaagggcaaaccttggaaaggagaatcatgacatgagaagaaagacttttttctttttaaagggaagtaatgatatgtgatcatgcaaatgcaaatgtctgtggacattactgtttgctggtgggaagagaattttaatgtgtgctctatgcaaatgcattttataataaaacaaatgtgcaaggacttctgggggtgaagaggacagaggagagcagcagctgctaaatgctgatgtctgagaggcattggaggatagagccagaacgtgacactctggaaccctgagcaaattctagcagggaggatgagtcaaaaaccctatccttataaaaaatctcttacatttgacagagaactggatggctaatgaattaatatctggaagatctttttttttttttaccaagtgcttaagcatgagcaattatttctctgtgcttagaatgatcctcataagaggacatttaaaaaaccagcaaaaacctcccttttgtgtgttgagtcatgagacaaatgatatgaaatgcacaataaagcctagagaaagaccagtgcagagacagtgcacctgtagtcgcagctacttgggaggtggagatgggaggatctcttgagcccaggagttcgaggctgtagccactgcactctagactggacaacatagtgagaccttatatctaaaaaaaaaaaaaaaaaaaagaagaagaagaaggagaaggagaaggagaagaagaagagaagaagaaagactagagataaatataatgcaagctattataaactacttagtgtctttgtatcaaaatgagcgcgaatgtcaaagctcatttacggcacagtcctaggcactggtgaaagaatgaacagaaggcaggctctacaatgctgaacagtctggttttgaccaactgatggttattcatatctatatatctgaagcaattattaaaaagaaactgggaaaaagtctgtgtctctgtgacggagatatttaaacaagccattttgaaaatgttaaaaaattaaaattgtagaaagtcgaaccataggtgccatgttttgcctgaagtggtaaaaataccatctgcctcagtctttttagcagcatgcttatttcaagtagcagtaggctaaactacaggcatacgctcagctccagctggggaaaatacacagacgtttgtcgatgtttttctaagcaagagtagtcaacatattcgttttcttttagatatatatatattagttaccatggcaaaccaaacgtgaatgtggtccgagagccttctccaccagtcccaacacatctccaagaattcctacaattcaataggtggcactcttccctctagcactgagctgaagcggctctgcctaaccttgaggccagaagcctaaagagctggaacagtctgagatgtgcacctagggctgcaggacagtcactggaattaagatccccacagcattgtgcactggagcaaaagtgttagcttcctggtcacacttcacttctggtaattacattccatctaatacaacttctgcagttttaactaggtaagatattccttgtttttccatcttaaaagcgactaaggtaggattgccttacacagttaaacagcttccatctttgcccactgcccaggtgagtgagtttcagcaatgaggagagtgacttccagtgctgtgttaactactttaagagacagggagagatgtaatgaattaatagttgtcaagtgctttgatatcttaggatgaaaggtactacagcagtgtaaagcattcatatccaggctctatcacaacaggaactcaattaaaaagtaattcaatttctagctgagtgtctgtgtacagaccactattttgctgaatgagacacacatgttgaaggtccagttgagaatgattttaaaatgatcacctcttccacactctcccctactacctcaccatctgaaaccgacaaaattgagtgatgggccataaagccacagagtgcatgactgaaataattatatagttttttttttactctttattattttaagttctgggatacatgtgcagaacgtgcaggtttgttacacaggtatacatgtgccatggtggtttgtgcacctattgacccgctctctaagttccctcctttcgcgcccccctaccccccaacaggccctggtgtgtgttgttcccctccctgtgtccatgtgttctcattgttcaactcccacttatgagtgagaacatgcggtgtttggttttctgttcctgtgttagtttgctgagaatgatggcttctagcttcatccgtatccctgcaaaggacatgatctcatgcctttttatggctgcacactttcttgatatctgacttttcagacaaaatttggcttttgagtttacaaatacctatcacttggaaataaagaaatttccagcaataaatgaatttcacaatagtctcctgaaatggctgctgagtttttcaaatactattttacaaataactcctaccaggggaaccctaagccactaagtgtgatgcctatattagcctgaacatcatgaccacaaaaagcagagcacacaaagcagggaggagtagactttaggtcatgagatgcattgccaagagtccataacatactgcataaggcataatactgcagacatctccccaagacttagtagagaaagatataatctttcttctctatgttacttggatttaagtctgtttaaggctgacaggtctggattaactacctaaatcgagttatgtctttaaatatcagaatagcactacatattcaaggaggggtgggtttctatttactggcatgagaaatactattactgggcacttgaaaagacaaccttaggcaactttgggatggaatgtattacacagtcaatatactcttaaggcccggtgtggtggctcacgcctgtaattccaacactttgggaggccgaggtgggcagatcacctgaggtcgggagtttgagaccagcctgaccaacatggagaaaccccatctctactaaaaatacaaaaattagctgggtgtggtggcgcatgcctataatcccagctactcaggaggctgaggtaggagattgcttgaacccaggaggcagaggttgcagtgagccgagattgtgccattgcactccagcctgggcaacaagagtgaaactccatctcaaaaaaaaaaaaaaacctcttaaaatgactaatttgagtctacggtcctcgatcccagacctctcctaacctcctgtacgtctcctaacataacacgaatgtaatactcatgcacacatgtttgtcaagcactcctatgtaagcctgtgctagggagggtgatgcaaccatgagcaaggccaccgaagcacctgccgttagatcttttacatgctagtggaagaagaaataaacatgcacttaaatacaaactgataattttatgttatgataaatgttaaggagaaaaaaacagagcaaaggtggagtggctactttagatagggaagctggagtcaagggagcttgtgatggcaaaccctggcagtcgtgttcatgatggttgtcttggcactagcatagtgcctccaatatattaacatcaaataaaggctgggtgaggtagctcatgcctggaatcccagcactctgggaggctgaggcgggcagatcgctttgagttcaggagttcgagaccagcctgagcaatgtggtaaaaccccatctctacaaaaaatacaaaaattagctgcgcattggtggcttgcacttgtagttccagctacttgggaggctgaggctggagaatcacttgaccccaggaagcggaagtttcagtgagctaaggttgtgccactgcactccaatttgggtgacagagtgagaccctgtctcaaaaaaaaaaaaaatttaaatttaaaaataaataaatgtcggttgggtgaaggagtgtgtctggacctcaggataagaatgtctcctcccagatttagaatgggcctagggaatagaacagcactactctaaactgctcgttctgcactgaggaaactaagaaaagaccaaagagattaagtgaacaatttggtttggatgttttatcccctccaaatctcatgttgaaaagtggcctccattgttggaggtgggcctagcgggaggtgtttgggtcagggggtctgatccctcatgaatggcttagtgccatgcccttggtgacgagtgagttctcactcagtgagctcatgcatgatctggttgtttaaaagtgtgtggcacctcccctctcttgctaggtgacatgcccaataccctttgccatgtgccatgattctaagctcaccagaagcctaaccagaagtagatgtcagcactatgcttctcgtatacctgcagaaccataagccaattaaacctcttttctttttcattttttttgagacagggtctcactctcactcccgttgcccaggctggtgtacagtggcgtgatcacaactcactgcagcctcaacttcctggggtcaggtgatcctctacctcaggctcctgagtagccaggactataggtgtgcaccaccatacctagctattttttaatatttttagcacggagtgcagtgacacaatctcagctgactgcaacctctgcctctcaggctcaagcaatcctcccacctcagcctcctgagtagctgggagtatgagtgtgcaccaacatatctggctaatttttgtattttttttagagacaggattttgccatattacccaggctggtctcgaactcctgagctcaagtgctcctgccttggcttcccaaagtgttggccactatacccagacatatattttttttctttttatttttttagacagagtcttgctctgttgtccaggctggaatgcaaagacatgaccttggctcactgcaacctgtgccactggggttcaagcaattctcctgcctcagcctcccgagtagctaggattacaggcacgtgctaccacacccggctaatttttgtgtttttagtagggacggggtttcaccatgttgatcaggctggtctcaaactcctaacctcaggtggtccacccccatggcctcccaaagtgctgcgattacaggtgtgagccactgtgcccggccccagccaggtattttttattgcacggcaagaaaagactaacacagtgactgttaccagattttgcattgagttggtggcagagccattgcttggtccaggggtgctcttatttgtgcaccatatttttctctttgccattttccagtggaaatctcttccattgtcaagtgcttctgtgataagaaaccccagaggcattctttgagtcataaaaaaagcatcaccagtctgggtaacagcgagacctcgttccttaaaattaaataaataaagaaagaaagaaacaaataaaaaaaaatagccgggtgtggtgacacatatctgtagtcctagttacctgggagtctgaggcaagaggatcatttgagcccaggagtgggaggctgcagtaagctatgattgtgacactgcactccagcctgagtgacagagtgagaccctatctctaaaaaaaaaaaacaaaaataaccaaaataagcatcaatgttcaattgtcactcttttcccttatctttttattcatatgttagctttctgtcactaccacagtaaaaatcccagtctttatcttcaaactagtttactacaaccttcctaagcaatcttcttaaccctgctgatatcctcaaactgtgtcaaacgctttcctttcctctctgccttgagaaccaatgccctatcccccgattttctcctgcagcaggttgcttctccccaacttactgcgtgtgttttctattttcttactcatggcctctgttcactcgcttacttgctcattcactcgtcacttactaagtgtcaagtactgtgttgggtaccagatatactaagagaaaaaagaaactgtctctgccctccaagagctcacagtctaggatcagtctcataaatggatcattataatataacagagtaagagcagtgactgagaaatgcacagtgtattgaggaactgaggaaagcacctaatccagcctgggaaaccacagaggatttgctataggagacaatcccaaattaagcttcataggatgagcagagggagccagataaagacggcaggacattctaagcagaggggacagcatgagtgaaggcgcagagaacagaagcagtatgctttatgaaacttggtgctgctgcaggaccatgggagatgaagctggagggtctctttaggggagagatcacacagccccgtatatgccaacccagcaagctccgaatgtgccggatagacaacacagagcaatgaaggggtttttttttgagacggagtcttgctctgtcgcccaggctggagtgcagtggcgtgatctcggctcactgcaagctccgcctcctgggttcacaccattctcctgcctcagcctcccaagtagctgggactacaggcgcccgccaccatgcccagctaattttttgtatttttagtcgagacggggtttcaccgtgttagccaggatggtctcgatctcctgacttcgtgatccgcccgcctccacctcccaaagtgctgggattacaggtgtgagccaccgtgcccggcctagagcaatgaagggttttaagctggagagagaaacggtcagattggtggtttagacagccactctggctggtaaagatctgtggggacaaaagagaggcagtggagactgagcagtaggtttttcagtgttcagatgaagagactatgagcacgaggaatggaagagagaccaagaggaggagttggagtcaagaaaatgtaggctataaaactggtatgacttggtcatggaacaagaggtggggagtagaagtggtttctcacatggtaagtttctcacatggttgactggtgggatgacagtgctaatcacaggagagaggataagaaaaaaggctcagaggtccagcaccagggactgcaaccttcctaatgcaatatatggactttgggtgataacgacgcaccaatgtagactcatcaatttttttttctttgagacagggtcttactctgtcacccgggctggagtgcagcagcatgatctcagctcactgaaacctctgctcccaggcttaagcaatcctcccatctcagcctcccaggtagctgcaactacaagtgctcatcaccacacccagctaatttttacactgttttgtacagacagggtttcaccatattatccaggctggtcttgaacttctgggctcaagtggtcctcccacctcagcctctcaaaatgctgggattagaggtatgagccactgcacctggccttagattcatcaattgtaacaatgtgcttctctggtgtgggatgctgatggtgagggaggctgcatgtgtttggggtcaggggctataggaactctacttttcactcacttttgctgtcaacctaaaactgctgtaaaaaataaagtcattaaacaacagcaacagaaaggccagagatgtcagaaaagatgtttagtttagtttaagatgcactgggctctcatgcctgtgggagacccaagagggtaagtccacagcctgcgtttgggtatatgatgaggctcaagtacacatctaagaccgagtggcagatatggaagcccttggtttacaggtgctcctattatctagtttttcttgaaggaggcagataaaaggagagacggtcccaacactcctcatgggagggagagaaaggacttgacagcctctgagaccccaaaagctgcagagtctgagaccccagggaaaggcccagggaaaaagtcaaaaatcaaagaagaggcagtgaaggaaaaaaaatccttaactggggagaaaagacctgagacagactccaaaaaagccagagaccaagttatttgctgctcctagtaaatctgtaagaaaagcttcccacaccctaccgcaaatggcccccaaaccccaaaaaccaaagtatccctgtcaacctaaattcagtgattcaaccagaaggaaacatcagagctacctgaagaactttttagaaacactcaggtcctgacctgctttgcaaccttctccaagcgggagacccggacttacggattttttaaaacctccataggtaattctgacatatgttcctgggtataagaaccagtggttcaaagtaaatctattttgtaattgttaaaaaaaaaaaagagagactttattttcagcaaggaaagaagagtaaaggtgggggccatgggtgtgccccactaggctgccaggagagtgcgaggttccaggtcagctctggagaggcccttgagggttttggttgtcccacggcaagcagagcccttctgggtcatgtttctccctccctgtctttggagtgcaggtgtgctcacatcctggatattcctgattgttgcataaatcagatggttgacatgttcttttagccaagcagctgtacacatgccatacacctgctaaatgttccatttgtccctgaggggaaaacagaacgtgacccaagtgtgttcctaggcctgtactgatgcactgaaatctgacctcccgcagcagtttttaaccagggctgtgtgtcagaattatctgtggagacattttcaaaccactccagcctgcccctgtactgctctctccatcaggggattctgatcttggtgaaagagggtctgatgcagtggtacctaggcacatgtgttttcaaaagttccacaggtgatgtgagaactcctgcctttgagagctcaagtctatcctgtaaggtgctttctacttattatctgatggccctaaaggttgtcttccatccacaccccatagcatctttcaacaatagctagtgattttactgtttatttttcctcatcacatttgctgacacttgacattatttatttagtcctttattttgttattgattttccccactagaattgtaaatattctgaaaggaaagacttcatctagttgaccgttgtattctcaatacctaatacaatgtctggaatgaaacaggtactcaataataaatagacttcttgttgaatgaaccttattccacatgctattggcctgttacttaacaggaaatgtccttcagctctcaatgtgatcattctcttttgacctttcaaatataaacgaaagccaaacaccaaattgaaatgtgtaaaatagtacagtatgtataaaatctgcctaccttagcatagtccaatcttcctttttcttgagcctacaaaagaagaggggaaaattaatttgttacttctctaaaagtttagtgcttctataatttttgcttctcaaagaatagaactcagcttctctgtccccctttccctctctctatttaatatacatattgaactatatattataatccatgtaaattgcaagcatatagaaaagttaaacgaacagatcactgagcacgcatagacactacctagatctggcaggagtggatgtcacgactcttaatgtcacatgcttcagcatgtatcttatacatatacagcatctcatacatcaccccatgaccacaatcaaaattaatgaactcacaataatgccatatcatctaacacaaacctatattcaaacttcttcaactgttccaagaatatcttttatagcttttttccccaaaaccagaattaatcaagattcacacattgcattctggtttttgtgcctcttttgttgccttttatttattattatcatttcttcttttttgcctagactagtctctcccaatttttaacaaaatgaaaataaaagccatgcttcttttcataaaaaccattgactttttgagaagacaaggatagctgttttataaaatccctttttcttctttcttcattgcgtcatttaacttgtttctgttttgcttgtaaactgaaagttgggtctggagaaggctgctaagatttaggttaaacatttttggcaaaaatactttatgtggaaatattacatactccatcaattcaggaggcacaaaatgtcaggctgtttcactcttagtaatgccgtaaattcagctgggtgcggtggctcacgcctgtaatcccagcactttgggaggccaaggcaggcggatcacctgaggtcaggagttcgagacagcctggccaaaatggtgaaaccccgtctctattaaaaatacaaaaattagccaggcgtggtggcaggcgcctgtaatcccagctactcagaaggctgaggagacaagaaaatcgcttgaacccaggaggcggagactgcagtgggctgagatcatgccactgcactccagcctgagtgacagagcaagactccatctcaaaaaaaaaaaaatcttaacataacaaccagggttagtttttgctggcaggtcagtttgtgttttgcagacttcagaataaaatttctcctgccacttctgcatagaacaagagtcctccaacttacaaacgggttaggtctcaagaccattttgttcctgagtccaaatttacattatacaggtaattaacataggcagattacttccgtgagagaaaaaaaaagtttataatattggtcctaaagctgggcacagtggctcatgcgtgtaatcccagcaccttgggaggccaaggcaagaggattgtttgagcccgtgagttcaagaccagttgtggcaacatagtgagactccatctctacaaaaaataaaaaaaattagctgggtgtggtggtatgcacctgtagtcctagctacttgggaggctgaggtgagaggactgcctgagcctgggaggttgaggctgtagtgagccatagttgcaccactacactccaacctgggtgacagagtgagatcctgtctcaaaaaaaaaaaaaaaaaaaatggtcctgacccttcttgctgctttagaatcttttaaaaatttttctgaagatgactccatttttttttttttttttgagatgcagtcttgctctgtcgtccaggctggagtgcagtggtgtatctcggctcactgcaaactccccctccaaggttcaagggattctcctgtctcagcctcctgagtagctgggattacaggcacccaccaccacgcccggctaatttttgtatttttagtagagacaaggtatcgccatgttggccaggctggtcttgaactcctgacctcatgtgatccacccacctcagcctcccaaagtgttgggattacaggcgtgagccactgcgcccagcccttgtttttcttattttcatagtaagaaacttataaaacactgttcatgcacagttgttggcaccaccacaaaccactctaaaattgtgattaaatattttcagtgaaacaaaaggcctctgcaaccaatctactataaaaagagtaaggtcttcagtctgctttttgaagttttttagtgttctaggattttcagagaactaagaagagtttgaacttagtactgagatgcattgtaccaacaggaatatgagtgagttcttaaagaaatttcaaaaccaagctgttagtctctatgcttagatattttatatttattcgtttgtctgtttatgggcatcttttcccaaaatagttttgtctacactgaaaatcccaccatagtaacttctgcagaagtggtagggaagccctgaacacatctgtattgctcacttatgacctagctactcactttgatattgtccaaatatggactggccttgatcttacgaataatccacagatggcctgtgaccaaaatttcatcagcagcactttcccaacatgcttagtctttcagttctcaaactcgcagctgactcttgaattcatttaggttaatggacatctgacattgaggctgatcctgtggtcacaagttttccactttttccactctccatccttttccttgtcttttgctgactactatgaattgctcaagtgcagcacttttcaaatgacactaggatattctgaaatatatatttggtcatagtccagttttctggcatacaactcctaaaatcttcagaaactcaccaagtgatgcctttttgtatgttaacgagctgactgatggctggcaactcctgacttcaggatggggactggtcatggcaaagaccaagacaggattagaaggttagggctttcagcccacccccaaatttctggggaggggagaggggctgaaggttaacttgatcaccaatggccaatggcttaatcaatcatacctatgtaatgaagcttccataaaaacccaaaaatttgttccataaaaacacagaatttggagaacttctggggagctgaacacatggaggtttctatatggtggtacactggagaggaaatggaaaactccacgccccttcccacttgtcttaacttatgcatcttctcatctgtgttctttgtaatattctttaaataaattggtaagtataagtgtttctgttccaaaattcacatagctgtgaaaaagaaagtaagtgtttccctgagttctgggagctgctctagcaaattaactgaacccaaggaagtggtcgtgggagccccactttatagcaggtcaatcagaagcacaggtaacctggagcttgtgactggcatctgaaggtgggggtggggtaaggggggggtgcagtcttgagccctcaacctataggatctgacactatctccaggtagatcgtgtcaaaatatggtacgtgcctgttgtcccagctacttgggaggttgaagtgagaagatagcttacggtcaggagtttgaggctgcagtgagctatgattgtgcctgtgaatatcacttcactccagcctaggcaacaaagtgagacccccatctcaaaaaaaaaaaaaaaaaaaaaagaagtgtcaaaatagaagtaagttagagacactcagctggtgtcagcttgctgaagtgattgcttgcttgttgatggggagaaatccttgcatgttgggtcatagaagtgtcctgtgttgactatttttgagagactgtatcaaacacttttgagtgtgttttcttccactcacagaagcacaaactgggagtcctagagaattgttcctgaggtcaaacagctcaacactgagcacatctgtcatttcctcactgtcaatgttgcctctcttctaaccatctcctcttcatgctctctcaatattctcatcgttcagtgcttatcatgcggtgcttaagagtgttgaaagtagcatttgttgaaagttagaaagttgaacttctgtacttgaagactgaaaggcaaaccatggagaaactatgactgacaatgacttaggggtggaattttccttttggctgcattgagccacctcccactctgtctcaaaaaaattcaacaggtaagaagagtgaatataatattctttactgataaggacatctagaatagccctatcacaaattcctgtaaaaccatttttcccatcccatactttgtttatagactaatcatcttggaaaattctagtactttgaattacctgtgcttaatcacaacttatttgcaaacctcaaactctctcactttactttgtcttcttagcttggccactaccctgtcacccagtagggacacattgttggggatgacggcagagaaattccatggatataatctagatctgctcaacatcagctctataatgttttgaaagctgagagagtagaagcctacataaaatgacaacaccgttaccacagccattataatctgaacatgcaactattgatatgtggctcacccgaatatccttttcattttgtcacaataaatgttctagctctatgaaatcattttactcttgatcactttagcttgtacataaaagtatcatttattttaggaaaaaactctggtaaatatttaaacttctataggtatataatacatatatgtttccagctgatacatgggtataatatctaaatatgccaaacatacctgacaacagacattctgatatggtgttttctcacaaaaagctttagagcttttaaaaatatactgaccaggcacggtggctcatgccggtaattccaacactttgggagaccaaggcgggcagatcacatgagcacaagagtttgagatcagcttgggcaacatggtgagaaacctgtctctacaaacaataacaacaacaacaacaacaacaacaacaacaacaacacagcaaaaatcagccaggcatggtggcgcgcacctgtaatcccagctacttaggaggctgaggtgggcaaattgattaagtccaggaggtcaaggctgcagtgagctgtgattgcaccactgcattccagcctgggtgacagaatgagaccctgtctcaaaaaataaataaataaaaatatgtcaagttagatacaaataaatgatttagattcctacataaatgatatttctcattaaatactatccttattctttttgtaagatagttaatttgggagaagcgatagtttctattacacctcttggttgctcattcatttaacaaatactcattcagcacctactatgagtcagacactgcttaggcactacagacacaggcatgaacagaacagatcaaaatgtgtgacctcttggaatttatattctaggaggttacaaagtattgtgattgactgactgtttgattggttgattaaacagggtcttactctgtctgtcacccaggctgagtgcagtgctgtaatcacagttcacggcagcctcaacctctcaggttcaagtgatcctcctgcctcagcctcctgagtagctggggctacaggtatgtaccaccatgcctggttaatttttaattttttatagagatggggtctcactatgttgctcaggctggtctcgaactcctggatgcaactgatcctcctgccttggcctcccaaactgctgggattacaggcatgggccactgcacctacctacacaatactgttttagatatgcttcgtctacaatctcccaagctccatgaaagcaaggaaattttctcttgctcacaactgtatcccaagttgagatcagtgtctgagtgaatgaataaatggatgaagctttttctttatatgtattggttatgtactacttattcagggaatgtacaggaaaaacgaattttactcactcctagttctaggaaagctggatgtttttgtttgtgagctagtatgcaggtaatgtagagcccttagctgatgccttacatgtaatttttacccatatagaacaatggcatattttcattttctcacccaccttctatttataaatacactaaagaagggaacctaagcttccatctgtagaaaacaaattcaatgatttcatgaaaattaaccaacaaaaggctaggacagagaagaattagtgtaattaagtgcttcaaccttaaaagcagtgcgtctaaaggaaaagaccttagaatggaagttaacagatctccagagagatttcaagacatacacctcaaaatttcagggattaaaggccttgtctactgattacagcaaaaggcctaagatcttaattgtgaacacttcaagaggcattgtgacctgggaagatggatatgttgggagccagaaaatatggtttctagtccttcattggttaataacttgaataatttttacatttttgtataggccttcatttcttgatctgtagaacaccagaccagaccagaagttcccagatgctgggctctcacaaatgctgggctggatgtattggaatcacctgggtagcttgcgaaaaatgcagattctccatagcctacccctgtgattctgatttgtttgaggatcattggtctggcctatgtctaatgtcttttttaatttgtgcttctatgtgcatcagggtttacttcaaaggctgaaagagaacaactatgtaaactccataagtctcgaggagaatggactgcaacttttccctttttgttctgacacctgccacttatcatgtgtatttctagcagagcaagatattattattattattattgagatggagtctcactctgttccccaggctggagtggaatagcgtgatttcggctcactgcaacctccacctctcaggttcaggcgattctcctacctcagcctccctagtagctgggattataggtgcccaccaccatgcctggataatttttgtatttttagtataacggggttttgtcgtgttagccaggtagtctcaaactcctgtcctcaggtgatccgcccacctcagcctcccaaagcgttgggattacaggcatgagtcactgcggccagccagagcaagatattattaaaataactttctcacaggggcccaaaataggctgatataaaataaatggaatctatatttcaacagccagcagtcctgaacctcttcctgccacactgttcgtccccagaagccgctgtaaattctaccatacacagcaattccctgagggcttcattactagggtctttaaaagggattcactcatctttttgcctcctgtaggtgtgcttcttgtcaatccaggtcaagagaaaagaaagtaattttttccaaatctttagcagttcacagagaatgtgtggtttgaaccttgttttatcttttaaaaatgtgaaaatagacaagatagtgtgcctgtgctcatgacactggaggcctcctcggacagctatagtgaacactgtaaaacaatattccatacaaaagcaaaaaaaaaaaaaaaaaaaaaaaagccagcactctgattgagaggatgcacaaaggaattaattccaaaggtttatataccagtctctgtagactaaaggcagacagattccctgttggtaagtaatggatgtacaatgtggtcttttactttaagaaacaaacgtttttttataagtcaggtaacaaagaaggattggatgacataaatgaactgtttccaatttccaactactgttatctggagttgaaagctggatatggggacacctttttctaaaagcagaaaactaatattccacagcagggagtccagaaattgctagagactaatcatctctacttatcaggttattcttcccaaatgttacaggctatattttagaataactgccatttttaaagatttcctttttaaatcttcaaggaaaactaccttcccccgcaaactttttagttgaaagaatacaatgaacactcattttccctccacttagattcaacagttgctaacaccttaccacttctgttttccccctttctctccatgaccatttattatttgagagtaagttttagacataaggatgctcacccctagatacttcagcatttgtccctaagaacactgacatttactataatagttaattacttatttgtttgtctgacagggtctccctctgttgcccaggctagagtgcagtggcacaatcatggttcactgtagccttgacctcctggactcaagagattctctagcctcagcctcctgaatagctgggattacaggtacacaccaccacacctggctacttttaaaagtttttagtagagatgggatcttgctatgttgcctagctggtcttgaactcctggcctcaagcaatcctcccgccttggcctcccaaagtgctgggattacaggcatgagccactgcacccagccctataatgctatttaaaatacagttcaggctggccatctctgcaaaaaaaaaacaaacaaaacaaaacaaaacaaaacaaaacagtgtgtagtgtatggggataacagaaagaagggtcacaaatcagaaatctactacatctgctagcccggaagttagagcagcccactgagtattggtttggtagaagcaggccttgtgttgctcggctttctagttacagagctggaaagatagcagaatataaaggaacagggcaggccttttctctgctatcttggtcattctctatgaataagagagcgcagaaggcatgtgcaaggaagttaacaccattcacacctggactgctttgcttgggtacctgattttaccatctctttcaactgggaaagctaatcgacttttagaggcaagcgtggatgtctaaggaattaattttctcatattctgttcctttggttcactggagaaaaagaagcaacagcagatgtagaaggctatggtgtccaattttagaaaggagagaggcaaggagatactagatatactagagtaaggcgaggagatactacttgtattatctacataacaaatctctctctgctcagaggtcttgttatttctttgtaacctgtttttcttgctatgctgctctcttggaatctggaagaaacatgaaattttaaattgcacagtgtgaccaggaaaaaaaatcgactcaggtctcagaaaggccatgattaaggaaatcaggctaatagtagaatttagttgcttcctccagcagcaagttcccaaggcaacggccatcaaccttgatggagtacttcaaactcaccatgtcaagaacctaagttaaaccagtctttccacttaactttcctatttctattaatggcttaattttttctgttatcctagtccaaaatccttgttttagcctctgagtgccactccccagtccacacctgtcagcctctccctatcagatcagttttctagtcccatatattttctctgaaatgagttttacgcttaacctccttatcttcccattctcattgccaacactctgattgggcttttctcttgtgcttatcaatgggtttccaaaaacttcttaattgatctccttgcttttagtatctctttgttcctttcatcgtatataatatagccagatttacctccctcgcagctcagaccttgatcatatcaggctcaaaaactttcaatgtctgcttcatgacttcttcatcaagttggtttgccataggcaaacatcccaaagtcttttaaaaatttaggtaaaatttacataacataaaattaatcattttaatcatttaaaacagtataattcagtggcatttagtacattcacaatgttatgcaatcatcaccactaacaagtgccgaacatttttattaccccagaaggagacctgtacccattaaacagtctctcccgcttcgcctctccccaaccctgggcaaccaccagtcttttttctgtctctatgatttgtctactctggatgtttcacataaatggaatcatatgatatgtggccttttgcatctggcttctttcacttattataattttttttttttttgagacagagtctcactctgtccccacgctggagtgcagtagcatgatcgaggctcactgcaacctccgcctcccgggttcaagtgattctcctgcctcagcctcccaagtagctgggactacgggtgcctattaccacacccggcaaatttctgtatttttagtagagatggggtttcaccatgttggccaggatggtctcgatctcctgacctcgtgatccgcccccctcggcttcccaaagtgctgggattacaggcataagccaccgcgcactgcttataatataatgttttaaaggcccatacatgttgcagcatgtatcaatacctcattcctttccatggctgagtaatattccattgtatggatataccacattttgcttctccatttatcagttgatagacactgggctatttctaccttttggatattgtgaatattgctgatctgaacattcatgtacatatttttacataaaccagtcttttaaatatagttattactatttcagagcaattcttcatctgtccctgatactaccctatgtttttcacattccacccaaattaagacacttttttttaatttgacaacattgcatgcctgcacctgtatcactttttcatggtttcctttgcctaggaagcccccattctcatctttgctatccaatcttctttaaggactatctcacatattattaataccgacttcataaacctctttcttgacttttccaactgaacatcaattgtctttcctctatgctccccaagtggcatgaatcacagtattccttatgtttctatatttatgtatttatcttatctcctctctactgggccatagacaacctttaggcaacttatttctgtatctcctgtagtcaagcactttgtttccttaagtgcaacagaaagccttaagaaatattttaatttaggagatatctagagccatttcatagtctttgtggtcatgcatatagttctttcaaatgcctacattgtataccttctatgatagaggatgatattaatattattccttttgaaaccactaaaaatgtcttaaagaactagaagagtatcacatgtgttattaatgaggaatctgcatgtgcattttctcttttgtttaagaataggcatgtgttattttcacgcacaccagtcttgcctagcagtctttgttttactttctgaataaggagcaatagtaagctatctagggacaagcgagttacagcttagcaatggtaatttgtagtacacttaaggtatttcatgacagtgtcagaatgtcacaagcccaagtgacatttcagtactattaggaatagccaagaaaatctaaccataattcttatttcttcaggtgacttatagtggcagcagaaaactagaaggatcattaaaaataaagcttgctgacctgcaatagcccctggactccctgagagagtcagagctctgtggtgctctgaaggattctactttcttttattaggaatcaaaatgataactgagtaatgacttcacctccccagggtgaataacccattcactaacagtattttttcctgatcattatttctcagcagctacaaatttaaatttaaaattaaggcagggagagatctgtagaatttagtatggagaaaatgctcagcaaatgtttttcagctgtttccggtcttaactgccttttgtgaaagagtgtggttgtgtgcgtgtgtgtcaacatgcacatgcatccataggcctatagttgtgatggaagagggctacctaatcctaagatttttcaggagaaaggagctgctggagaagaggtggcacagcctgataaggaaaatcccaggggtgctcttgctcctagcttcacaatggtgctgaacgggtatcgagagtatgtcacctcctggcttccttgtctagtcaataattctcagtctttccaagcaggaaatcaaaacagtagatgagacacaaacctgcctgggcagagtaaagaagtaattttaaatgtggtaataagaaatcacaggtgacttccatcattgacagcaagatttttctgtttctcagtgttaaaacttgtaaaagtttctttttttgcgggggacagaatctcagtctgtcacccaggctggagtgcactggtgcgatcttggctcactgcaacctctgcctcctgggctcaagtgattctcctgtctcagcctcccgagtagctgggattacaggcatgcgccaccacgcccagctaatttttgtatttttagtacagaccgggtttcaccatgttggacaggctggtctggaactgctgacctcaagtgatccgcccacctcggcctcccaaagtgctgggattacaggtgtgagccaccatgcccggcctgtttctaatagagataaatatttttcttataatgcatctcttgtctaagagaactagttcttggatttattttagagctgaaagggactttggaaaagatctagtttaatgccatcattttacagaaaagaataatggggatatgagagaatgtgattaagtttacttagatgctagcagagtccaaattagaatctagaccaggagtgtccaatctttttgcttccctggaccacactggaagaagaattgtcttgggccacacataaaacacatgaacactaatggtagctgatgagctaaaaaaaaaaaattgcaaaaaaaccttcataatgtttgaagaaagtttatgaatttgtgttgggccactttcaaaactgttctgggctgcatgcagctcataagggctggacaatcttgatctgaccttccaaatcctggtcctctgtgggccatttctgttataccaacttaactctaacaaaaccgggctgccaccaaacagtctcaacctgcaagaccacaccacactcactttttgacaaatattaatttggtaattactccaagtaagccactgtggcaggtagtatgggtaattcaaagatgaatttgctattattgtttttttttttttttagacggagtcttgttctatcgcccaggctcgagtgcagtggcgcgatctcagctgactgcaacctccgcttcctgggttcaagtgattctcctgccttagcctcccgagtagctgggactacaggcgcccgccactgtgcccgactaattttttgtatttttactagagacggggtttcaccatgttagccaggatggtctcgatttcctgacctcgtgatccgcctgcctcggcctcccaaagtgctgggattacaggcatgagccaccacacccggcctgagtttgctattattgttaaggatcttgcaatcaaattcaaaactgaaggagagggctttaggggagggaaggaaaggatctcaaagatatccaggagggtaaataacatgaaaaaatcagaaagagaactaatttcaggattaataagcaacctccttgagatttagggtggaatgtctctcctaggtgttatgcaaattgtgttccctatttctgactaggaggcattcacagaacaagatggttatcttataaagctttacataaaaatgtacattacaatttagaagattaaaataaactcagtaaagtgtctttttttttttttttttttgtgagacagagtctcactctgctggccaggatggagtgcagttgtgcaatcagctcactgcaacctctgcctccagtgttcaagtgattctagggcctcagcctcctgagtagctgggattacaggcccgggccaccatgcctggctaacttttgtatttttaatagagatggggtttcgccatgttggccaggctggtctcaaactcctgacctcaagtgatctgcccacctcggcttctcaaagtgctgggattacaggcatgagccaccatgtccagccattatttttatttttaaaaatgtgttaattttcttacctctgtttttagttttctctgtctatgacttgtttttttttttttttttttttttatgaaacagagtttcactcttgttgcccaggctggagtacggtggcgcaatcttggctcaatgcaacctctgcatcctgggttcaagggattctcctgcctcagcctcccgagtagctgggattagagacatgagtcaccaagcctggctaattttttgtatttagtagagacggggtttcaccatgttggtcaggctggtctcgaactcctgacctctggtgatccacctgcctcggcctcccaaagtgctgggattacaggtgtaagccaccatgcctggccttttttttttttttttttttttttttttttaaagacagtctcactgtgtcgctcagactggagtgcagtggctccatcttggctcactgcaacctctacctcccaggttcaagtgattcttgtgcctcagccacctgagaagctgagattacaggcgtgcaccaccacacccagctactttttgtattttcagtagagacagggttttaccatgttggccaggctggtcttgagttcctgacctcaagtgatccacccccttggcctcccaagtgctcagattactgggattacagacatgagccaccacacctggcctgtgacttttttttttttttttggggacggagtttagctcttgtcgctcaggctagagtgcaatggcgcaatctcgctcactgcagcctctgccttataggtgtgcaccaccacgcccagctaatttttgtatttttagcagagacagcgtttcaccatgttggccaggctggtctcgaactcctgacctcaggcgatccacttgccttggcctcccaaagtgttgggattacaggtgtgagccactgtgcccagcctggcctgtgactcttaatagatacaaggtttcctgaaagagtccttagttttcttattttttttctttttttaaaaaatcatcttttttgtccacttttctgggagattttttcatttgtatcttccattcttctgattaaaaaattctgcaatcatatttttatattttataattctaatttttattcttgaattgtcctttttaatggatcatctattattataccatggatttaatatccttccttgtcaagtatattgattatagtgctttgaaaaacatctgcctttgattgcattgtctctatttccgctaagttccctttttatcagtttgtttttgacttgctgtttcgtggaagcagcttttctcaaatgcccagtggtcctcttttcctattctgcttcagagtaaggcagcagatattctgggcacttagatcctctgaggcttgtcaagtggtgggtcttgctgtaggaggactgctcagggatatgccatgtttactgaggaggccccaaatatccacatctgcaaggctttttctcctgagtttgacagtttcttcagaaagaaatcctccagttttctacttggtgaatatgaggaattttaagttggcagccagcattttgagaatcaataagggttgggaggagggaaatctttcagaacgcagatactcacttaggctctaagcttttttttttttttttttttaaatttcaaaaactttaattttgtagagatgaggtttcactatgttgttggtcttgaactcaagagctcaagtgatcctcctgccttggcatctcaaagtgctgggattacaggcatgagccactgcgcccacccatgctctctcctttaaggatggtggctacccccaccctcagctgtgcctggtttctctgtccagagcctcagattaacccaaccaattacagccacgaagttaaataaattccaagaggctttggctaaaaaggcaagaagttttgcactagagtttctgaattaaaagaaaaccaaaaaagttccctctcatctgccaaaatgagaaattcacccaattcaagcccctttacccctcccacttcgccatgcttttttcccccccgctttgataatgcctcagaacaagtattcagggtccaagtttgttttaaaataacccaatgagctgacagacggagctcctggaattctgcagcttgtgcgagagtccacagatgggaaattgcagtcagttatagggtggtgctattaccatagcccaatttttgaaagcctttagaaaaaaaaagtcatctgagttaattagcattcaccacaggcactagttttgtgttgcagtattctaagaactcagataatagaaaaattcagtactgcaatctctaactttaactaatcttttacctcttaaaaacgaagattacaaagaaaggattttacctgttacgtgaatatgcctaaggctcatctatagccatatatcaccaagaaatatcaattatgttctaaaatccactaattactactggtacctaaaacaggagtaatttcattttacctctccgatctgtttaatccacaaatctcttccaagaaattcctgatgtaagactacaggagctgagtttagattaaaagtcatggagtcactggtcttttctttaataaaaggctggacatcagaatttatctacaagaagcaattaaatgagtaaattagtgaaatgtatatacactagtatgttttagttatattcagaaagtaccagttaatgcagtgaaatatgaagcttaaggaatgcagtttttagatatactttaataaacaaaagaatatttcaggccaggtgcagtggcttacgcctgtaatctcagcagtttgggaggctgggatgggtggatcacctgaggtcaggagtttgagaccagcctggtcaaaatggcgaaaccccatctctactaaaaaaacaaaaattggggggggtttgcacacacattccagctactagggaggctgaagcaggagaatcgcttgaacctgggagacagaggttgcagtgagccgagattgcgccactgcactcccctctgggcgagagcaaaactccgtctcaaaaaaaaaaaaaaaaatttcagatgattaacaataacctgtaaaattctccagaattattccctaatacattccttttctagtgggtggtggtctttattttactttttaagttaaaggaaaagatttagataaagatttaataaatagaattgcttaataaactaatctaagattaaataaaatatgcaaaaagctcacctggagatattatatatgtatatattcccccccttatgaactatttaagtaacatctgaatagtatatattaaattaaatttaaaattatatatatagagagaggcaacaacacagcagctaatcttgggatattttagatttcatatgcccattcaaagaattagttattaaaattaaagctttcaattttattcactatatttctgaattttattaacttttcataacatgttttatataaagagctataaggggccaggcgtggtggctcacacctgtaatcccagcactttgggaggccaaggcgggcagatcacgaggtcaggaattcgagaccatcctgaccaacatggtgaaacctcgtctctactaaaaatacaaaaattagccaggcgtggtggcatgtgcctgtaatcccagctactcaggaggctgaggcaggagaatcgcttgaacctgggaggcagaggttgcgttgcagtgagctgagattgcaccactgcactccagcctgggtgacagagcgagactccatctcaaaaaaaaaaaaaaaaaagctataagggaactgtaacaaaaaagacaaatattcttccattatgtgaatatattccagtctgtaaatatgttatttaataatatgtaagagttctctcaagaaccctttcaggtgggaagaaaagacaaacatcacaaaaatggttcaagtaaactgtggctttctgtaagaattacacaatacttagcaattatactatttacattacataacaatcatccaggactgacagatttgaaccacacaataagcatttttgaaatataaaagaagcttattaaatggcaaaaggtttcttgtgtgtcgttttagctatttaagtactgaaaaaagataaagggtgtgcaaagtaccttatgactcatggccatgtgcttcccatactgaaatgccatattctgaacctcagcatcatgctttgctaattccattgcagcttggcagctctttgctagtaaggcaccatgggagagaaaagtctgctccttccaagtcgatattccaatatcatctgtgatataactttcctaaaaatgtaacaaaagccaagataaaaaagactttaggagtaatttaattgtttctgtttttgaagaataaaaaagttaagaaacgaactattcaaaaacactcaggctattggaacaagacagaactaaaagatgcctaacctcagctctacctaaaaagaatgtggtgggaaaactgcttttttatggtaatagggggaaagttaaagaaatgttaaagcaaattttattctaagctagggaacttctattaaaatataccctacaggataagggaaaaagtagaaagacttcaaactaactcccttctatagtcaatatcagttcttaagtgctggtattaagcacaagaagcctattgcatttaatttatgtgaaaatgtcaagggcatatggaaggaactacattttcttagaaataattaaatagaaaaataaggctgggcatggtggctcatgcctatagtccaagcactttgggaggccaaggcaggaggattgcttgaggccaggagttcgagaccagcctgggcaacatagcaagactctacaaaaaaaaaaaaaaaaaaatagctaggcaagggggtgtgcccctgtagtcctgactactcaggaggctgaggcaggaagatcacttgagcccaggagttcaaggttataagtaagctatgattgcaccactgcactacagccaggatgacagagcaagaccctgtctctttctctccccctctttttatttgagacagggtcttgttctgtcacccaagctggaacgtagtggcatgatcatggctcactgcagccttgacctcccgggctcaagcgatccttccatctcagcctcccaagtagctgggaccacaggcatgcaccaccacaccaagttaattttttgtattttttgtagatacagagtttctccatgttggccaggctggtcttgaactcctgagctcaagtgatctgccagccttgacctcccaaagtactgggattacaggcataagccaccacacccagataatttttttttttttttttaatagagatggggtttcaccatgttggtcaggctggtcttgaactcctggtctcaggtaatctgcctgccttggcctcccaaagtgctggaattacaggcatgagtcactgcgcccagtttaccctctatcttaaaaaaagaaaaagaagggtgggcatggtggctcatgcctgtaatcccagcactttgggaggctgaggtgggtggatcacgaggtcaggagttcaagactagcctagctaacatggtgaaaccctgtctctactaaaaatagaaaaattagccgggtggtggcaggtgcctgtaatcccagctacttgggaggccgaggcaggagaatcacttgaacctgggtgggagaggttgcagtgagtcgagattgcacccctgcactccagcctgggcgaaagagcaagactgtctcaaaacaaagaaacaaacaaagcaaaagaaagaaaaatcagagaagatgtaatctattataatggagaatgaatattatagtcttcatgaaagtttattctcataagaaacaaggtgtaaaagaggatataatttataaataaatatatacacatctaccacctctagaccaatgctgtccaatggaaatataatgtgaaccacatatgtaatgtaaacttttctagtggctatataaaaaaaagtggaaacaggtaaaattaatcttaatgacatattttatctatcccaatatatccaaatatcattttaaacatatattgaatatgaaaattattagtgagctattttacactttttttttttttgagatggagtctctctgtgtcacccaggctggagtgcagtggcgcgatctcggctcactgcaagctctgcctcccgggttcactccattctcctgcctcagcctctccgagtagctggactacaggcgcccgccaccacgcccagctaattttttgtatttttagtagagacggggtttcaccgtggtctcgatctcctgacctcgtgatccgcccgcctcggcctcccaaagtgctgggattacaagtgtgagccaccgctcccggcctttacactttttttatactaagttttcaaaatcactgtgcattttatacttacaacacctcactagccacaatttaagtgctcagcattggacagtagggctctgaggaaaggaatgctgaagcaaacatataaaaccatgttcattttatggcatttatttgaaacgtcaaactaactggaacctacccagaaggattaattaactcaatacacttttcttcctgctcctgatcctataatcctttctcttttcacaattgcttggagacaaaataaaaaatattaagaaaaaaaagtggtcaccaaaaggtcagctgaaatagagccccctcctcttctgccatgttgaggggcatcttcagcccactggtcaaatcaaattattagcttaacttcatgcaatgtttttgagatggggtcttgctatattgcccagactggtctcaaactcctgagctcaagcaatcctcccacctcagctttccaagtaactgggatcacaggtgtgtgccaccatgcccaacatcaccttaattttattaagtatttgaacaacaaaaaaaattccacttatggcaatggttgcaaatatgcaacacagcattggataatgacagaaaagccacacaggagagaaacaatgcataatgttaagaccttctttacaaaacattaggtataaattataacatacttaattttataaatctgagaatgtattttaaaatgtgacaatatatattaataaacctaagaaaaaccatattatctctccatatatactgcagaggtatttgacaaaattcaactcctattcttgatgagaaaaaatgtccagaataaaataggaagagctgggtgcagtggctcacacctgtaatcgtagcaactcaggaggctgaggagggaggatcacttgaacccaggagttcaaggctgcagtgggccataatcatgccactgctgtccagcctggatgacgcagtgagaaccctaactctaaaaaataaaaaaatagcaactgatgtgtatttctttaatgtgataggggtgtgtgtgtcagcccaaaagtcagcaaatattttatgaggaaacatgagcctttctcactaatgtcaggagtaagacagagatgcacacaacaccactgatatttacaatgtaatagaagagataagagaaaggtagatgtaaacaaattaggaaagatgagtttaactcttactgtttgaaggcaatataactgcatactgggaaaatcaagagattcaactaaaaaactactataaactagaagataattcagtaaggtagcagtgtctaaaattaataatttattattaacataataaattgtattaactatagctttcatacataaaaactaatcagtaagttttataaataggatcttttctttcattatgaatacaaaaataaaagattaaaaaactgggaataaggtcgggaacggtggctcatgcctgtaatcccagcactttgggaggcagaggtgggcagattacttgagtttaggagttaaagaccagcctgagcaacatggtgaaatcccgtctctaccaaaaatacacaaattagttgggtgtggtgtcttgtgcctatagtcccagctacttgggaggctgaggcaggagaatgacgtgagcttgggaagcagaggctgcagtgagctgagattttgccactgcactccagcctgggcaacaaagggagaccctgtccaaaaaaacccaaaatacaacaaaaaacccaaaacaaagaaaaaaacctaggaataaggccaggtgaggtggctcacacctgtaatcccagcagtttgggagggtgagggggcggatcacctgaggtcaagagtttgagaccagcctgaccaacatggtgaaacccagtctctactaaaaatacaaaaattagccgggcatggtgaagtactcctgtagtaccagctacttgggaggctgaggcaggaggatcactcgaaccagggaggcagaggttgcagtgagctgagattgcgccactgcactctaacctggacaacagagccagactccatctcaaagaaaaccaaaaaaaacaaaaaacaaaaaacaaaacctgggaataagcttagaaacgcgcaaaactgaatgcgcaaaactgaatgaagaaaatgttaaaatactattgcaggaacaaagataactcgaatgaatataaagacatatcatgttcaaagatagtaagatccaacctcataagttactccaataaaactaacaataccttttccctctgacactgggcaaactgaagttcatatgggaaaaataaacaaagaagagcagccaggaaaatcttgaaaaagaagagcaatgaatgtgtgtgtgttgggggaggggtggagagggacagcaaattttgtctaagccttaccagatactataacatgctgtaaaatctcagaaattttaaaaatatgtactttttagatagagagacagactagggagcaaaatagaaagtccagaaagcaaccaaactatatatagggatttgctatattttaggaagaagttgaacttttcagtaaatggtgctggtacaactaaagagctatctggaaaaaataaagtctgagctgcatttcgtactatttaccaggataaactctaaatggcaaaaacagcaaaaccaccacaaaaccacgggcaatgttaggagacaaaggacaatgaggaaaacaattcatatttcctatcacagacaaacggcgaatctccctgaggtaggctaacaatgctcaatgtttaagcaaagatgtctatatcctaatccctggaagctatgaatgttaccttacaaggcaaaagggactatacagatgtaattaaattcaggattttgaaatgaggggattactctggtttaactggatgggctcaatgtaatcatagtagtccttataagagggaggcacagtcaaagtcataaaaggtaatttaatgacaggagagagaaatttgaagatgagagatggggccatgagccaaggaataaacatggaaattagagaaggcaaggaaatggattttccaatagaactccaggaagaatacaagtctgtcaacatcttgatttagtgacttctgaccaataaaaaaaaaaaactctcagcttccctcttagtgatggtaaggctgtgaccaaataggcctctcaaatatggctggtggaagtggaaactagctggaaattccacaatctctatcaaaattataagtgaatttgccctgtgactcaggaatcccatgtccaggaattaatcctacagataaacctacatacatgcgaaatgaaatatgtacaaagtgtgaaagttgatcacagaaattgggtcaatcttgtcacacctgactaaaacagagttgagaagtcacaggaggaaaaaggacttagaatatgtaacattgctccaaaactgtaagtctctacaagcctggctgctcaagctgcctgctataatctcaaatcagttttatctaatagttgctgaaataacttgctgcaactctaagactaattttatccaccactatcattcactaatcaaaatctgccaactccccagaaccttactagtgcggatgaactctctcaaagagcaatatgtaacatttctccttttcataaaacctccaaccttctctctgttcttcagacatactaaagaccatttggtctgtgtgtacaccctgaattgcaattctttcctctcaagtaaactgttaaatttagatatttggctctctatacattttatttgactttgacaaaggttacagtctgttgttcacccaactgccagggtgacctttaaaaacacaaaccagaactacaatggcctccagctgttccaaacactctaggcatcacctcctagatgcctcttggcctctaggaggcctctgcacttgctgttctgcagatacactctctagacgtttgcatggctagatttctcattacttttgggtctctacttaaacttcaactcatctttaatagtctaccagcctcccccattatttcctatatccttaccttgcgttaaacctttcttccttgatattactggaccactcatatacttatttgttaaatgagttattgtctgtctcctttactagactataagttccatgaaagcaaggacttggtttggcctctgctgcacaatcagcatctaatatagtatcttaggtgggcaataaatatttgttgaattttttgtctttcttttggtatctctctccctcttttgtaccttcctctatctttcctaacttggtcagaataaagaattgaaataattctcctttaggctggatgcggtggctcatgcctataatcccagcactttgggaggccaaggcggccggatcacctgaggtcaggagtttgagaccagcctggccaacatggtgaaactttgtctctactaaaaatgcaaacattagctgggcctggtggtgggtgcctgtaatcccagctattcaggaggctgaggcaggagaatcacttgaacccaggaggcagaggttgcagtgagccgacatcacgccattgcactccagcctgggtgacaagagtgaaactctgtctcaaaaaaaaaaaaaattaattaaaaaaaaattctcttttaatgcctctctactgctcatagaatcaagatgaactctatagcatagcattcaaggcattcccttttatagtaccaagcaatacttctagtcccatctcctacacaaaatatcccctttgaggcctgaatttaacacacaggggaagttgctgtttcttgaataaaatacatattttcacacttgcgtgaatttattttatttatttttgtgatggagtcttgctctgtcacccaggctggagtgcagtggcgcaatctcggctcactgcaacctccgcctcccaggttcaagcaattctcctgcctcagcctcccgagtagctgggactacaggtgcgcaccactacacccggctaatttttgtatttttagtagagacgattttcgctatgttggccagggtggtctcaaacttctgacctcaggtgatccacccgccttggcctcccaaaatgctgggattataggcatgagccactgtgcttggcctacttgtgtgaactttaaatctaatccagatatcacttctttgaggagcgctctcaaatactaccacaaatattttcctctttagactaacattatcttatttatattatgacacagcagttaattctctctgaactgtatgatttcttatatgtttccttgaaggttagacctggtactagtcacttttatattttttaatcacttaggccatattcaagtttcaagtatttgctaaatgaatagtacctgtttatctgttgcattattaagtagatgtgtgcgtgtgttttaaatgttaaaagctaatgggtagatatggacatataatgacatgctattcagcaataaaaaggaattactgacacatgctatgccatggatgaacttcgaaaacattatgctaagtggaagaagccggacacaagagaccacatatttgtataattccattgatgtgaaatgtagattagtgattgcctggggctgggggtgggaactgtaaatgggcatgagggaccttataggggtgtgtgtgaaaatgttctaaaaatgatttggtaatgactgtatcacttgataaaagttactaaaaatcattgaatcgtaggcttgaaatgggtgaattttatgacataaaatatacctcaataaagctgttaagaaagaaaaaagctaatgagcataatattttacatttattggtctcaaatgtttaaattaacattttaaaaaatgtatgactctcaattaactgtggtttgcatatcatcctcatttattcatgcaaaaaaaacccatttattaaggttctattatggttcaggctttctgcaaagcaatatagatatgaagattaataaacagcctgtcctcaagaagctcacagtccagggatagaatgtatatatatcaatatatagatataactatatagatacagatatctatatatagaatgtatagataattctatttcagaataattgaaagatctctaaaatcaaagattcagttttgtttattacatatttcttactgtgattaagactttattattcatcatttctacattttaaattattcaagtaatacacgatcactggaaaaaaaatagaaaattcagaaaaccaagaaacgattaatttatagtcccctgaaatctactaccataagttaattggaccacaaattaactgttcctaagttaatcagaaattttattccctaaacattattaccttttatgagtttggttactaatgaaacaaaatccctcatttccatcagcttgccgtgtatatactaagagagcatgctctattataaaggaaaagttagtataaattgtaaaatgccaagaaactagtatgataaccacatccaaatcagtaccttcagataccagatatacagaattgtgaaatgaatgcatgttagtcagagtaaatgagatttagatatacctatatcaggacgggcgcggtggctcacgcctgtaatcccaacacttcgggaggccgaggcaggtggatcacgaggtcaggagattgagaccatcctggctaacacggtgaaaccccgtctctaccaaaaatgcaaaaaattagctgggagtagtggcgggcgcctgtaatcccagctacttgggaggctgaggcaggtgaatggcgtgaacctgggaggcggagcttgtagtgagccgagaccgcaccatggcactccagcctgggcgacagagtgagactccgtctcgaaaaaaaaaaaaaaaaaaaaaaaaaaagatacacctatatcatcaacttacatatgtgcagtttttactaaggtttattatacagaaaaggaggatacattcagtgaatatttacttttgacgggatttcctttttttttcctgaaaggtgatagatgtcaagatacttgttgaatgactatcagagagaagtatgttaattttttttaaatgtaggtctcactgtcacatgacctttttgctgaagtaaggctggttcaaataacatgggaaaaaaactgaaacttgcaagatgatgcttgcttgagatagtggtactggtggttttgctcagccatatgctgctctcctactttactgctccgagagatactttgagttgcttttctaatggtggtgagacatttgtacatatctactcacatgagaacaaactgcacttgtaacagtggctgctcaggattaaaggtctggtccatggtcacagaacaaaggtgaactaattggcccggaaaggtgtcaaagccccagcaagaacctgccaagccaaactgctacctttcacataatcagaaaagaagaggtggaaacaaagaagctagctgcctgtgaagttaaaagtactttttaaaaaagtatgcaaatgtcgcctgttttcatgcttaggatttcagattcatattctgggtcactatctttataaatacaacctaaatttgggttggatgagacaccagatctctctaatgacccatttcaccatgttaaatgtttgctttgaattagccttttcaattattttgagaaactggacagccaaaaatttacataccttattattttttttaaaaaaggtcaagtatagaaaaatgtctataaatctccacatttgggaatcagaaaaaagcaaggaaaagaatgcaatctaatatctcctgggagctaactatgtgatgacacttttatgttctttattataacagccctcagaaatattaattatcattattcccatttaataggtaaggagggccgggcatggtagctcacacttgtaatcccagcactttgggaggccgaggtgggtggatcacttgatgtcaggagctcgagaccatcctggccaaaatggtgaaaccccatctctactaaaaatacaaaaaattagctgggcgtggtggcagcacctgtaatcccagctactcaggaggctgaggcaggagaatcacttgaacttgggaggcagaggttgcagtgaaccaagatggtgccactgcactccagcctgggtgacagagcaagactgtctcaaaaaaaaaaaaaaaaaaggtaagatttcaagaatgtattttgaccaagattagaccgtagtatgtggcagagatgagtctcagaagtatagcaattggattccattttcttagcacataacagaatatatgcaatacttaatatatcttacggtttaaaagcaggttgtagactgggtgtggtggctcatacctgtaatctaagcacattgggaggccaacatgtgaggacagcttaagcctaaaatgtcaagaccagcctgggcaacaaagtgacaccctgtctctacaaaaaaaattttttttttttttttaagatggagtatcaccctgtcacccaggctggagtgcaatggtgcaatctcggctcactgcaacctctgcctcctgggttcaagtgattctcctgcctcagcctcctgagtagctgggattacaggtgtgcgtcaccacacccagataattttttgtatctttagcagaggccaggatggtctcgaactcctgacctcatgatccgcccgcctcagcctcccaaagtgctaggattataggtgtgaaccactgcgctctacaaacatttttttaaaaaattggccaggcatggtggctcatgcctataatcctggcactttgggaggccgaggtgggcagatcacctgagctcaggagtttgagaccagcctgggcaacatggtgaaactctgtctctaccaaaaatacaaaaaacaagccagttgtggtggcatgtgcctgtggtcccagctcctcgggaggctgaggtgggaagactgcttgagcctgggagggaggtggaggttgcagtgagctgagatcatgccaccacgctccaggatgggtgacagagtgagactccatctcaaaaaacaaacaaacaaacaaacaaaaactagttgggcatgatggtacatgcttgtggttccagccacacatgggaggctgaggtggggagatcgcttgagtccaggaggtcaaggctgcagtgagacacgttcaggccactgcactctagcttgggcagcagagtaaaaccctgtctcagggttgtagattgtatttaagagtgaatgacatctatgtacccgcccccgaccccgacccaccaagagcatttaaacttgtaaatcaagccctttaatattatccattgaagaaatcccagagtctagagcaggggtccccaacctccaggccatggactggtactaattctgtggcctcttaggaactgggctgcacagcaagaggtgagcggtgggtgagcgagcattactgcctgagctccacctcctgtcagatcagcatgggcattagattctcaaagaagtgtgaaccccgttgtgaactgtgcatgccagggatctaggttgcctgctccataatgcctgatgatacgaagtggaacagtttcatcccgaaaccatccccatgcattgagtgctgtattctaggtgtgcaaggatgaggtaaagtggggattgagaagcaacaacaatatgagctgctcaaaaagcgaaacaagatcactccttattgtggacaggacagttgctcatccaggatccatttctctctcctctccctgcttactaataaaaccgtaattttcttcaggtatttactgctcctgctaatgattaatttaggaaaggatatatcatccaattctagcctaagagatatgagggaaatccaccactgagctcctaggaaagacccacgtagaagtgggagttgtttcctctagatgttgccctgtcttgacaggacataccaagggctactgtagcttaactgctaccaggctgatgataaagacaacagtaaggaaggcagagcacggacagagagggcttcaatagtgctgagttgtcatgttaaactatccctgatgcctgactacctctgcatatacagttagagtaaaatatatatagagagagtaaaatatacatcttcacttatatgcacatctatttaattgggttttccatttttttgctgctgaaagcattccaatgaatttactccctaagataaaaaatggttacactatacgaaatctagatatgccaacattaacaactactagaacatgtaagtatttccttaggatggtgtattagttatctattgctgcaaaacaaactagcatcttaaaacaactgacatttattatttcacagtttctgagggtcaggaatccaggaatggctcagctggctggttctggctcatggtttctcgtgaggttgcagtcatgctgttggccacggctacagtcatatgaaggggctgaagaatctgctccaagctcaattaaatggttgtcggcagtaggctttagttcttgccacacaggccactcacgtgccatggcagctggcttccctagagcaagtgatccaggagagtaagaacacacccaagaaggacgaaggaagcttcactatatatatatttttatatatatatatatatatatatattttttttttttttttttttttttttttgagacagagtgtcactctgttgcccaggctggagtgcagtggcatgatcttgggctcactgcaacctccgcctcccgggttcatgtgattctcttgcctcagcctcctgaacagctgggattacagatgtgtgccaccatgcccggctaatttttgtatcactgtattggtcaggctggtcttgaactcctgaccttgtgatctgcctgccttggcctcccaaagtgctgagattacaagtgtgagccaccatgcctggccttcttcactatcttttataacctaatcttggaagtaacatgccattgcttctactctatattattggtcacacagatcaactctagtacaatgtaggaagggtttgcacaaggcgtacaaggaggtggggctaattgggggtgatcttggtggctggctaccacagatgaagttcgtgattagaattattggggtcaacagatctgaatatataaaaatctcttaaaacattctttcaaattgttttctagaaaaattcttttgatctgcatactaaccagccaagtttgagactatcttgccattaagtagaattattgtttcacttttcagataaaaagtgacacttcatttaaacttgggaagacatttcacttattagccatttgttcttcctcaatttattcatttattaaagattcactaagtataaaaaaaagattgactgaatatcttctatgtgcaaggtaagtactcatgccaatgagcaaaaccagagagttcttgctctcatagttattacagtctaatggggaagccaaacaattggataaccgcacaaagaaatataattatagccaggtgcagtggctcacgcctgtaatcccagcactttgggaggccgaggcaggaggatcatgaggtcaggagatcgagaccatcctggctaacacaatgaaaccctgtctctactaaaaatacaaaaaaattagctgggcgtggtagcaggcgcctgtagtcccagctactcgggaggctgaggcaggagaatagcgtgaacctgggaggcagagcttgcagcagtgagccgagattgcgccactgcactccagcctgggcgacaaagcgagactccgtctcaaaaaaaagaaatataattataaactgagatacttctgatgcaggaaaatgaacatacttctatgaccacatggaataaaagaacttggctgagactggggtttctggagatggcttccctgaggacatgacacttgagctgacaaaggaaacataaataaggggtaaagagtgaaggagatggaaaagtgtgttccaagctgcaaggatggcccatacagaggaggatgtctgtggatcagctattagggctgatatgcagacagtgagggtgagaatggtagaaagtgaggctggagggacagactgaggtcagactatgtaagcatcttttgggtcactttcaggattttggaatttttttttttttttttttgagatggagtctcgttctgtcgcccaggctggaatgcagtggcgcaatctcggctcactgcaacctccgcctctggggttcaagcgattctcctgcctcggcctcctgagtagctgggattacaggtgtgtgccaccatgcctagctaattttttctgtatttttagtagagaagtggtttcaccatgttggtcaggctggtcttgagctcctgatctcatgatccgcctgcctcagtcttccaaagtgctgggattacaggcttgagccaccgcgcccggcccagccaaacccagccttttttttaattacttttttttttgagacagagtctcgctctgttgcccaggggcacaatcttggctcattgcaatctccgcctcctgggttcaagcgaatctcctgcctcggcctctcaagtagcttggattacaagtgcccgccaccacatctggctaatgttttaaatatttttggtagagacagggttttaccatgttggccaggctggtctcgaactcctgacctcaagtgatctgccggccctggcctcccaaagtgctgggattataggtgtaagccactgtgcccttttttttttttttttttttttttttttgagacagagtctcactctgtggcccaggctggagtgcagtggcacgatcttggctcactgcaacctccgcctcccaggttcaagcgattctcgtgcctcagcctcctgagtagctgggattacagttgtgtgccaccacacttggctaatttttatacttttagtaaaggcgggtttcaccatgttggccaggctggtcttgaactcttgaccaagtgatctgcctgcctcagcctcccaaagtgctgggattacaggcttgagccactgcatcgggcccagagtctacttttaaagagagtgctccaaagagaaattccttctctgctccctcccagttatgcttctggtgaaggtggtggtacggaagagtaaggcaggcaccaggtgaacctggtaaggagcagaagtattaaggatgacttacaagtttttgacttgaaaatctgaatgaatggtgatgtgttttatgaagatagagaacaatgggatggcttcgaagggaaagatcatatatgtggtcttagatgtcctgagtctgagatgcctgtgagaacttcaagtggaggtgttgagaaaacagttaaatatttagctccagagcccagcagtgacccaggatggagataaaaattgggactcaccagcctatagacagatggtaattgaaggcttgggtttcattttctgaatggcttactcttgtcctttgatcagaatggtattctgttaaacactttacatgcctaatagtgatgttttatctctcaggcaaataaactgccttttaagatattttgctgtgatagttgtaagtaacctagagtgcctccaaatggtatacaaattcaatttagacatttaacaaataaaaacattcatcaactagatccactctaaatttgagggtctacttaatcaaaagggccactatacatactaagctttcttagtcaccaacagtttctctgccttctcaatatctatatcaaccttcactttaccactttgcatatttaatctaatactcctatatttgatttctaacatgtatacttcacaaaacatttgctacttttatttttttaattaaaaaagtttgctaggccaggcgcggcggctcacacctgtaatcccagcactttgggaggccgaggtgggcagatcacctgaggccaggagttcgagaccagcctggccaacgtggtgaaaccccgtctctactaaaaatacaaaaaattagctgggcgtggtggcaagcgcctataatcccagctacttgggaggctgaggcaagagaatctcttgaacccaggaggcagaggctgcagtgagcagagatcacaccattgcactccagcctgggtgacagagggagactctatctcaaaataaataaataaataaataaataaacaaacaaacaaacaaacaaacaaacaaaacaaattcctctcaatagtctttaaatctgaataagttcagtatttttacttgcatcaaacgatttatgactgtggttactttataaaaaaggatgccagtaaaattaaaggtatttattatcaccactagcatcttcaaagtctttatttgtgagtgacagaagcttgaacaaatgcccagcaaacaataaaacatgacatgacatgttttattagctcattaatacatgccttgggtacaatgtgagggacaggttgtgagtaaattgaccaatgaaatacacttcagagtatcttactgcttttacacagcactcattgttttacttttaaacctcttagaatatacacttttttaaaaaacagcttttacatgtatatataattaagacatttttaactccaaggaaaaaaaatacattttttcctatttctgtttgtttttagttttttgagacgttgtcttcctctgtcgcccaggctggagtgcaatggcgtgatctcggctcactgcaacctccacctcctgggttcaagcaattctcccgcctcagcctccagagtagctggggttacaggcgtgcaccaccatgcccggctaatttttgtgtttttagtagagacggggtttcaccataagccaggctggtctcaaactcctgacctcgtgattcacccgccttggcctcccaaagtgctgggattacaggtgtgagcaactgtgcccggcctcacttttcctatttctaatctactaaataaaactttcaatataaacccccttctactttggtagggtgaattagcttctttgaactcaaactcactgattccctctttctagtcgacgtcccctgcccaccttcatccatttttatggcaacagtctcaaagccccgatcttccattgttattactctgtgcttctgtaggcatacatgtacaataatgtctacatatgaacactgtagtcctctctggctgctggaggatctactatcatcaggaactctatggtaactatctggtccaggaagttcatgaccaactgactgactacttcagtggaaatacaacaaatggtaattgatgtcctttatccttggagggcaacagtacctaaggcagaaattcagagaaaatctaccaaaatctcactggatgttatatttgtatttggattcagagctcacattggtggcggcaagaaaactggctttggcatgatgtacgactcgctggattatgcaaagaaatgtgaacccagatatggacttgaaagatatagcctgtgtgagaagaaaaagacctgaagaaacaaaaaaactgagcaagaacagaatgaagtcagtcagggagactgcaaaggtcaaagttggtgctggcaaaaacaaggagtaaagattttgcaatgactttgtggtgatcctgcaaattcagtcaccacaaacgacaaaactgaaggaaaaaaaaaaaaaagccactgtaggtgcttcatgaacagccctgacatggctttcctgaaactccaagtaccaaacctttgccctctccagcctggggaggattgacattccactactaaatggttcctaaccctggagggtaggacttaggtcctcaggctagaagcctccagttaaactcttcaaaccagctccctaatctcacgcttggcctagaccaccagttccccacaaatctcttaatccatctgactccagtttactattgataaaggtacccccaaactcaggggcttcaaacaacaatcatttattatcactcactgtctttggatcagctgagattcagctaatctagactggtagctctgcctctcactgcacatctctaggttggctggagaggctctgctccaagggtctctcactcttcctggaccagcagactagccagggcatgtttttctcatagtgatgagaaaaacatgcccaagagagcctcttactggtcaaagcaagtgagcccagagttaaaggacaggtaagtaccccctgcccataatgggaggacattacagtgacatggcaaagggcatgaatgtgtacataagttatctactgctgcgaaaaaaatgaccccaaatttagtggtttaaagcaagagtaaaaatttattttctcacaatttctgtaggttaagaattcaggaggcggggcacggtggctcatgcctgtaatcctagcacattgggaggccaaggcatgaggatcccttgaacccaggagtttgagaccagcctgggcaagatggtaagaccccatctctatttaaattaaaaaaaatttttttaaagaattcaggaatggctaaactgggctgttttagcttggggcctctcatgacagactagaaatgctactttctgcaaagagacagaaatgaacctgtacaaataccctatactcctaattattatcaattactttttaaaccatatttttgtgcaatgcaataagtttcatgtgaaaatgctgttttggaggggcttagcatcaaaataaaagactgtgatatgcaaagaacaggttaaaagatggtagatgttgacttagttccacaaaatacacagtaagagagtaataaaacaggagacatcagttgtaaatgacttaataaattgaaaggtaggatacctgctgaactcctgcgcccttgccctacacttgtttccactgccaacaatctcgtctgttgcttcacacctgtttttatttcaacgctcctccagctggtctctctgcttctaatttctttggcttccaatttatcctattcacagcttctacataatctttatcaaagatcttactgtataagaccctatggttatttgctactgcttactattttaaatccaaattcctcaatacaaatgttcaagatctatccactgagttatttctcccttcaaaaattatcacctggctgggcgcagcactttgggaggcagaggtggatggatcagctgaggtcaggagttacagaccaggctgaccaacatggtgaaaccccatctctactaaaaatacacaaattagctgggtgtggtggtgcgcacctgtaatcccagctattcaggaggctgaggtatgagcatcgcttgaacccgggaggtggaggttgcagtgagccgagatggtgccattgcactccagcctgggcaacaagagtgaaactctgtctcaaaaaaaaaaaaaaaaaattatcacccttccctagtaaagccccagctccagctcctattgtacctttgtctctatctcagctctcaagacacgggtacctgatttgtctagcacagttgctagcacgtaataggtactcaacatctgttgagtgagcagtcctagagtaataactaaaacagagtaataactaaaacagaatgatagattcctttccttagttagatttacttgaacctgtgtccaaagcaccttcatgtttatactacatatattttcataacacctgtctgcccctctgaaattgaactactgcagcctcgaactcctggctcaagtgattctcctaccttggcctccccagaaactcttctattcacccaccatgctccatctgggtgggccttctttctattccttggacagattaaggcaattccttcctcaggcctttgctggagttgcttcctcttcctggaatgttttttccccccaacatagttagctgctttttgtcattcagatctcaacttaaatgttatttcctaaaacaggccttccatgaacatccaatctaaagtaactccttcaatccttcactatcatttctccctatttagttctctcctatacagttattgcttccagttatttctcttgttcatctattcatgtgatttcttgtttatagttggcctctccactgagatgtgagctccatgggggcaaagatgtctcattcactgagcacttgtatttccagtgcctgccacacagcagatgctcaaaagacacattaaatgaataaacaaatctgacttcccagctaatgctcaatgactatttcctgatcccaacaaacttcaatagtttctttctttcttttttttttttgagacagggtcttgctctgtcacccaggctggagtgcagtggcgcgatctctattcactgcagcatcgaccccctgggctcagcctcccaaggagccacaggcatgtaccaccatatctagctaattaaaaattttctttgttcagacagagtctcaacatgttgcccagactggtctcaaactcctgggctcaagcaatcttcctgccttggcctcctaaagtgctgggattacagatgtgagccactgcgctgggtccaatagtttctattgattcatttctactgtatcttctaaggactcagctttaaaattacatcttccaagaagctccctctgaaacattttgaattcttaatgctgcactttctcctacatatatagtctgttccttacaattttacatgtggtcttatgggaaaattgctctcctgtggcttcatgtgcatgtatttcctatgacctgtaagcatcatcagattcttgagggctggcctgtgttctttattgctttgttttgaatgttccaggagtactcaatatgctactcttcacacagcagaaattcaatacaagattactaatatacactttaccaaaactgcctaatatagctctatgggtactataggattcatgataacaaacaatttaattagaatccagtgagaggccaggagtggtggctcatacctgtaatctcagtgctttgggaggctgagatgggaggatcacctgaggccaggagttccagaccagcccgggcaacgaagggagaccttgcctttacaaaaattaaaaaaaattaggcaggcgtggtggtgtacaactgtagtcctagcttcttgggagactgaggtgggaggatcccttaagcccaggagtctgaggctgtagtgagctatgattgcatcactgcactctagcctgggtgacagagtgagaccctgtctctgaattaataaatataaatgtaaaaaaaaaaataaagactccaatgagaaacaattaatctagaatttccagagcctagtgtagtggcacatgcctgtagtcccagctacttgggaggctgaggcaagaggattgcttgaggctaggagcccaagaccagcctgggcaacatagggagattctgtctctaaaaaacataaaaataaaaataagttatctgtatcattagtaattatataatgaaaaactcagaacataatatattttctcttttggtgttacttgggaagaaactgtgtcaaattcaaagtccaattacagtaaagcctggtagataatcactccaacttcctttccatattctccaattctccattctatttttatctttttttttttctttttttctttgagacggagtctcactttgttgcccaggctggagtgcaatggtgccatctcggctcactgcaacctctacctcctaggttccagcgattctcctgcctcagcctcccgggtagctgggactataggcgcgtgccactatgcccggctaattttgtatttttagtagcgacggcgtttcaccatgttggccaggctggtctcaaactcctgaccttaggtgatccacccacctctgcctcccaaagtgctgggattacaggtgtaagccaccacgcctggctctatttttatcttactagatttttttttttttgtctacctaaaaatatttgcctatcagtctacaaagatgaattcccaaatcatctttctggagctctttactctttcatctggagagtctgccagcacctcaacattaattcaacctcaactaaacttatctgcttctctctaaaaccagtctttggctggcaactatataatcatgttttctggtcaattagatgcaaaacattggtgtcatttttgatttcttattcccatggccaatgtacccaatagacacactaaacatgcacttagggtaccagcaatgcaatagcaccataaaatttataggagggaaatgttttatttgttatttttataaaagtcattataacataaatttttaaaagtcctgaaaatcagcacttccagccaagatggagcaaaagaggtgaggttttctttcttgcttgaaagagctaaaaactgaagaaaatatatgaaacaaaagttataagccatttgaaatcaggcaacaaaagacagtgacacccaagaaatgggaaataaatgagatgagtttcataattgttctagcttctgcctggagagaatgccaggatgcagaggaaactacctttgagttgaaaaggtgaacctggatgtctagagaagccgaaggggttaattaggggctagggttcatagggcagagtacacaagaagagagagctgcagagagagctctgaaggtaaacacagatcctccctaaagtcttcggctgagtattgccaatgcataggtacaaagaaactactaaagtccagggaaagaatcacccagaaggaacagcagaaacaatccctagagatcacacagggctgggaataattcctgttccacaagtcagagtaaaaaatttcaaaattcatagggcatcagtaaagaactcagaaaggtctcgctttaatagtgaaaaaaattggccttagactaaatgctattccagtcctgcctaataaagcttaaaagtgacacctgaaagaatcaaactgttttcagtaacttaactacattcaagaagaaagttcaagaatatttatagtgatacaaaactatctagcatccaacaaaataaatttcacaatgtctggcacccaaccaaaaataaccaagttgcaaaaaaatagggaaatacaacccataatgagggagaaaaaaatcagtcaattgaaaccaacccaggaaatgacacagatgatataattagtagacagggatattaaaacagttttcataactatattccatatggccaaggagctagaagaaacactgagcatattaagtagaaacacagaacatgtaaactggtctgcttgaatgcacaccaactgaaatgatccaaaatgaatcacaaatactaaaaaagaagaagaatcagtgactctgggacaagttaaagcagcctactatgtaattgaggtccctataaaagaggataaaaggaaagtcagaaaaaaaaattgaagaaataataatcttttccccgttttatgaaaaccaactcacagaaccaagaagcccagtgaatcccaagcaaaagaaacatgaaaaaaagaacatgaaagcacatgataatctatttatgactacaggaacaaagataaagatggcagtagctttcctgttgaaaataataaaagcaagaagacaatgaagcaacatctttaaaaatatggaaggaaaactaaattgtcaacctagaactctatatccagtgaacatatatttcagacacacaaaagctaaaagagttcattactggctggacgcagtggctgacacctgaaatcccagctactcaggaggctgaggcaggagaattgtttgaacctgggaggtggaggttgccgtgagctgagattgtgccattggactccagcctgggcaacagggcgagactctgtctcaaaaaaaaaaaaaaagagttcattactagcagacctgtcttataagcaaggttaaaagaaatcttttaggaagaaggaaaataatacattctggcattacagatcttctaccatgcgttataaacacctacttttgcaatattacttttcactgttcctttacttctatgtgaaggaagccctgatctcaaatatgctttctttccattcatcatgctatttcctctacttggaatgccatacatctccatctatagacatcttcccaatctttaatgtccatctcaaatgtaacattctttttgatgccttttctgatttccccaactagatgtgagttcttgttcacattaccctcctgttatttttcttaatgggaaaaaaatcatttggctctttttactatgttttagatggcagcacagggctttgcaggtagaagacagtccttaacttcctagtggactgaattatcttttttttttttttgagacagggtctcgttctgttacccaggctgaagtatagtggcatatactcactgcagcctcaacctcctgggcttaagcaatccttctgccttacagcctcccaagtagttgggactacaggcataccaccatgtctggttaatgttttaatttttgtagagatgggttcttgccatgttgcgtaagctggtctcaaactccttggctcaagtgattgccctgccttggtctcccaaattgctaggattacagatatcagccatcactcctggcctcttttatttatttatttatttatttatgagatggagttttgcttttgttgtccagactggagtgcaatggcatgatcttggctcagtgcaacctccatctcccaggtacaagcgattctcctgcctcagcctcccaagtaactgggattacaggcacccacccccacacccagctaattttgtatttttagtagagacggggtttcaccatgttggtcaggatggtttcgaactcctgacctcaggtgatcctcctgccttggcctcccaaagtgctgggattacaggcatgagtcaccgtacctggccctggcctcttatttttatactttacttgaaagctgcctgagagcgaaaggaacataagcataaagaaaaacaaatgggccaggcacagtggcttacacttgtaatcccagcactttgggaggtcgaggcgggcaggtcacctgaggtcaggagtttgagaccagcctggccaacatacactaaaaccccacctctaataaaaaaaatacaaggcgctgtggtgcatgcctgtagttccagctacttgggaagctgcggcaggtgaatcgcttgaagccgggaggtggaggttgcattgagccaagatcgcaccactgtactccagcctgggctacagagcaagactccgtctctgaaaaaaaaaaaaaaaaaagaaaagaaaataaatggacagaaggacagaagttatcttgccccacaaaaacataatgatattcatcattataatccactgactgatactgaaagtattaatataatccgtgcttgaaaaaaatagatgggatctttgcaacttaagtcacttgctaaaaccagttctttcccaagagaactggattctcttttaaaaccctctcactttcctgagactgaggccaagccaataagagctgaacctctggagacaggaaagaggtgtcttgttccccatctcaacaccaacatgagtcagagacactgcctttgcagaggaccttgattaaattccccaggaaggatcaggagtgggtggaaaataaacaataaaaaatcagaaaatgagtgtgttcgggatctccaaatcacccccaggtttgatgatttgttaggatgacagatgttactcagcatatagtcaaattcatcgtaatgacttttttacagtgaaaggatacaatgcaaaaccactaaaaagagacagccccatagggtgaagtctggaagaaaccaggtgtaaacttctaagaatcccctctcagtggagtcacgcagagtgtgcttaattcctccaagaatgagctgtgataacatgtatgaaacattgtctaccacggagatttactggagactgacttagtggtgagggtttttattagggctggtcatgtaggcattttctgcctagcatgtagcaaaattccagactcctataaggaaagcaggtattcagtataaaccatattgtctgtaaacagtttaggcactgcgagccattcttatcatttggaggatggtaggaacactcctaaaatccagcttctccgatgctagccaaggatcaaccttataagcaggtttttctcaggacagtaatccttttctgcacagaggtatactgaaaatactcttcttgatttaagaatctcactttcaggatttttttttttaagcaaatagtatgaaattgagcaaagttatatacagtaagatgttatcacaatattgtttaatttagtaaagaaaactggaaacaggccaggcactgtggctcacgcctgtaatcccagcacttgggaggctgaggtgggaggatcacttgaggttaggggttcgagaccagcctggccaacatggtgaaaccccatctctactaaaaatacaaaaattagccgggcatggtggtacacacctgtaatcccagctacttgggaggctgaggcaggagaatctcttgaatccaggaggcaaaagttgcagtgagctgagattgtgccactgcactccagcctggatgacagagagagactccgtctcaaaaaaaaccaaaaaccaaacaaaaacaaaattggaaacaaagtaaatgcccccaaaatgtgaaattgttcagtaaattacagtataacaatgtgaagaaatattaaacaatcattaaaattatatttttgaagacttttaatgacaaaaatgattatgctgggaagtaaatcaatatgcaaagtgttatatacagtaacaactcaaaattgggagaaatacagaataaaatctagaaagaaatatactaaaacataatcatgattcatttctggggaatggttttataaaataatttttattttcctcttgacctttttctgttttcaattattatttaataaacatgtactctacctttttttttttttttttttttttttgagacagagtctcgctctgttgcccaggctggagtgcagtggtatgatttcggctcactgcaacctccgccttccaggttcaagcgattctcctgcctcagcctcccaagtagctgggattacaggtgtgcgccactatgcccagctaatttttgtatttttagcagagacacggtttcaccatgttggccaggctggtctcgaactcctaacctcaagtgatctgcccacctcagcctcccaaagtgttgggattacaggcgtgagccaccgtgcctggcctatttttctaatcagaaaataagttaaaatgataagacaattagaatttagatatacaggtctgtgaatccaaagtcaattttgtaaaaatgtaaaatatttagtgagtacagtaagtaacatgagcgtaatatataaaacagcttaactggggaactcttgaccatttaaaatgcaattttccagctgagcatggtggcttatatctgtaatcccaacactttgggaggctgaggagggagggtagcttgaagccaggagttcaagactaatttgggcagtatggtgagaccttgtctctacaaaagttttaaaaaattagacaggtgtggtggtaggctactgtggtcccagctattcggaaggcaaggactgcttgagcccaggagttcaaggtttcagtgagctaggatgacaccactgccctccagtctggatgatagagtgagaccctaccttttttttttttttttttttgaaactgcagtctcactctgtccaggctggagtgcagtggctcaatctcagctcactgcaaactccacctcccaggttcaagcgatcctcctgcctcggcctcccgagtagctgggattacaggcgcgcaccaccaagcccagctttttttgtatttttagtacagatggagtttcgccatgttggccagcctggtctcaaactcctgacctcaggtgatcagcctgcctccacctcccaaagtgctgggattacaggcgtgagccaccgcacctggctgagaccctacctgtaaaaaataaaaatttaaaaaaaaaaaagcaatttttctatttcaaatgcttctttcttcaatgagctaacatttaaaaagcagagaggggagatattttcttataaacactaaagaaagcagaatggctaatttttattataatgagcaaatggttcacaaactagccaatgcaaaaatgaaaatatatttcaatggatagaacaaaggatgaatttcctaagctattttgtatgtttatatagctgtaattcaacttacttagtacagtaagtatgagtaagtaatagcactttgggaggctgaggaggatgggtcgcttgaggccaggagttcaagaccagcctggccaacatggcaaaacctcgtctctactgaaaatacaaaaattagtgagacgtggtggtgtgtgcctgtagtcccaactacttgcaaggctgaggcacaggaatcgtttgaaccgggtaggcagaggttacagtgagctgagatcgcgccactgcactctagcctgggcaacagagcgagactcggtaaaaaaaaaaaaaaaaaaaagtattagtaatataagtcatgtacattttcacagctttaaggagaattaggtaattgctctacaaacctcttcttcttctttttttttttttttttttttgagacggagcctcgctctgtccccaggctggagtgcagtggcgagatatcggctcactgcaagctctgcctcccgggttcacaccattcttctgcctcagcctcccgagtagctgggactacaggcgcccaccaccacgcccagctaattttttgtatttttagtagagacagggtttcaccgtgttagccaggacggcctcgatctcctgacctcgtgatctgcccgcctcaacctcccgaagtgctgggattacaggcgtaagccaccgcacccggctgctctacaaacttcttttggagaaggtgacttctaatgtatccagttccaattcccttgcattttttgctatgcatctaccttagtcacatatatgctatttaacagaaagctattttcctactacccaggatcttcaccactgcattaagctgccatatagaaaacagactgctattgtatcctcttacccctagaaagatgaaatggtttgcagcttcttttaaatcacaaaaaaattcttttgtgtactaaattggcccaaggctacggaggttgtgcaacagagatccacagaggagcctctcttcccacatgacctccacttgtggctgcttcccagtcctgccagaacatgaaaaccttgaaagcactccatgtgggggcagtgctctctctggcatctgaagtacttcttgcgctgttagaaaaaacaaattctgaagagccattgcaatggtaagcacactcaggaaaaaaagccagaatttttctggttaggaagggaaatgtggttaacctaaattggacctgaggcacaaatggaggcatcaagaagcactcccactactacagttcaactatgcatttttgtttccattctttttgaaaaaattattattattattattattttgagacggagtcttgctctgtcgcccaggctggagtgcagtggcgcgatcttggctcactgcaagctccgcctcctgggttcacgccattctcctgcctcagcctcctgagtagctgggaccacaggcgcccgccactgtgcccgcctaatttttttatatttttagtagagatgagatggtctcgatctcccgacctcgtgatccgcctgccttggcctcccaaagtgctaggattacaggcgtgagccaccacgcctggccaaaaattattattttttaagagacaaggtcttgctgtcacccaggctggagtacagtggtgtgatcacagcttattgtaacgtcaaactcctgggttccagtgatcctcctgcctcgcctcagcatcctgagcaggcatgggctaccatgcccagttattttattttttgtaaagatggggtcttcccatgttgtccaggctggtcttgaactcctggccccaagagatcctcctacctcggcctcctaaagtgctgggattataggcttgagccaccacaccattctgtttccattattaaaaaagaatggccctttaaatggtttggctattttcagaaatttaactgcttaaaaaagggctatgaggaggtggcagggaaagaggacagatgaatgaagcagtgctataaagtctctttaataaaatgtagctaatgaaggttagcattcctctgaatctctgtatttaaataaagtcagcaattggtgcttgctaagtggtggttcaagtacaatcaacagcccttcaaagactttgttgcttcttcttttctctttttcaggaagaaacacattaaaaatattagaaaaagcatgggactgagagtcaagaaaaacctgggttcattatgaactgtgaaacatgttaatatattaacaaataattttcagacactatgctttcctgccatttgttatgtttgaatttcaggcttttcctctataaatgggaataccaacaaatgtcacccttttcataggtgattgtgtacaaagaaagtataagcaaactgtaaagggctatctaagtattaactgtcgtagctgtcaggtttccctgacataaaaaatacttaaaacatggtcacacaattattaatgaactgagcttattatagtggacaaatggtaagagtagataaattaagaaccttaaaaccaacaataatgctttcatgtaaaaattaacatatttaattgtgaaatatagatatcttatatggaactaagttgaacactctggaaatatcccaagggaaaacagtgtctcaacagccagaactggtcactataattatcatagagtgggatctcaggtatggcagacagatgctatcaaatcaggtttcactaaagtacagaagatatgggagcgggtacggggaagtgctgggtagagaaaggcaggtcctggctggggctccactcctacagacctaggtgaggacaggcactcctgcttttgtgcctaactgttgcattttccaagaccactgtggtctgccatgcccccatcctgggctgggcatggtggctcacacctgtaatcccagcactttgggaggctgaggtgggcagatcacctgaggtcaggaggtcaagaccagcctgaccaacatggagaaaccctgtctctactaaaaatacaaaattagccaggtgtggtggtgcatgcctgtaatcccagctacttgggaggccgaggcaggataatcgcttgaacccaggaggctgaggttgtggtgagccgagatcgtgccattgcactccagcctgggcaacaagagcgaaactccatctcaaaaaaacaaacaaaacaaaacaaaaaaagagtctgggctcttgacttcaaatccctgagagctaacaagttgtgtgaccttgggaaaattacttaaccttttctcaaccccagtgttcacatctgtaaaatggggatagcagtagtacctatctctcaggatttctgtgaggattaaatgaagaaacacaggcaaatcacttactacagggttatttgcttagctgttgtcatcttcatcatactatctatacaacgtaactttttacaagtggaactagaccagtagtcacccattttacaatcagatattaacctccatccatagtagtgaacttgcatgtctttgaaaggtccactgtggtcatccatcctgtgaggtctctgcataccaatatgctgcttaggtgaggccagatgtgcctactaggaactgtggttacttgaaccaaacgttggcagatgtccaaagtgcaattcttcatattctaaccagtctctgaaccacccagagtccctgggttatacttttaaattttaaatttcttatccaagttactcatgccctatgtttcacttctaataaaatttatcttccttttttcaaatgaaaatgtcaaaaagcttaagatgtgcatatgtgcataccttttctaatttgaagtgagtgaaatcttgctaatacagaagctaaagaagttagaataatgaaacactaagataggagccccttataatagtatctaccatgttaaatgatggtgatggtcaatgaagcaattacttcacatctaacatcctaccgaaatgaaataactgcattttaaggaaatgaaacctaacctttcttgagatgtcctgctaaatgagtcaaaaaaatcttaattctagacctataaaattaatcaaaataatccaactgtgcaatcatcccacttcttataataaagaatctaataatgcagtaaattatgcatcttgtatataaaagatacccccatcccacctccccaacagtcatcttcttaggctcaaggtccactcctctgtgacacggaaggacccttcctctggggaaaggatgggctcagctgcctcagcacgagctgctcctccagcctgcctgcctgtgacactgctacctgctagccagaagcatcccagtgtctactgagctgctgcagattgaacagactgtgaatccagccagaggataagaggttgttttaattggctaaatctgctatgtagtaagcgtatggccatgaatttgtagccaaaacactaatcaaaaaaaaaaaaaaaaaaaaaaaaaaagccatgtacaatttaaacacaaaacaagaatgacattttcgttattctagttgtaccacgacggtttataacataacattttatgactctgaaatcctttacctttgaagtagaattttcatgatatactccttgtaccaagtccataagagcacttgctaaaagttccacaacctaaaaagcaagaagaaaaataaaaataaaaaaatttaaatatatctctattgttacctcagaatgtttcagaaggctcagtggcaaggcagaatttttctgtgcttgacagaaaaaatgggactatgcaccaagatctcagcaaatggcattgcccacctggatattaaagctgtgatccaaattttttcagtcataattcaagccaaaaaaaatcttataagcatagcatttaactaatatacatgaaaatcgagtaatagccattttgaacataaacttacatttcagataactaatgaaatcttaactcaatttattttctgcatgtttatttctgtcaggtggatactttttcagtactcccattctgggagcaattacaatgttaattttcatacttattacagaaaaaaaagcaaaagcaaaagaatggataatctttcaaatatgttcattctgttacacttaaaatgcactgtggatatatttactgtggggtccctgggtcaaatgtaccataaacactgaaaatttttacagaactgtaatactgaaatcatattcatcaaacctgtattatttttcaaggctgagactttttttttttgttaaatcaagtgagatcaaaagctttgaacttgttccaggatgtaaaacaagcagaaaacagtaaatggtctctttggaactactgtacaatttagagtagtttgcataaagcatcttaatttgagaggataaaatagtggtatttatgataatgttcaatgtagccatttcaaataagaattcctcaaggcaaccccatccgcttcttacaagtcttaatatcttgtatatttaacttcctatgttatgcagtcctgtatcagatttccactctttgcttccgaaaattcagctccattctgattgaattaaaggattttgtttcagcttttatcattcttgtaattgaagacattattaagccaaagaatacagacccaaacaacaagatacttcaatctcaggtaccctgggtttaataaacattttcttagaggcaaatgacattaatttgtagaaagatttgctttaacattttaacacatgagcacttatctccaaatttatatatttacgtttatactacataacatacacagaactgctgatatgaaatttttgctgattaaaggcatatttttttcctagctctttaaggatggtttaatttgtaagacatatacaaagtcttttttattttttttaaatcacattgtccttcaggtaaccaaatacttaagaaatattgtagcaatatgagctgcagaggaactggaaggacaatgatcctacagtgttaccacatgagttgagttatttaagtggggaagagagaaaaatgaatggatttttttccccctgaaggtatcagataagccctattcctaaatccaggaggactgagtatcgccaataggtctatgaaagactgtaactaaacgcacagcatcagattggattacagtttacacaagcaacatcccaagatccccctgatggctggacacataatacagatcaatcactcactaagaaatgttatggttttgaaacagtttgagctctgagaccagcattggtaacgtgaagagggatttacaaagagaaagtctgacgctaaatgtcaaaatgatggcatgaacttttaacagtggatctggctctggataaccagagtgttcctttacttccctgaaattccagaccaggcagaagcaacaagaacattttgttctctgactctttttctcattgcgtaaacctgtccttacaagttcataatttataaatgacctgtacttacaaatggctatacttacttgaacagaacacacctccacctccatagccaatgacaacccattaaggaaaaagctttagatttctttgagttaacaagtcgaggaaggaaagagattataaaaagcaagagtagcctaagaagttgaaactgttccagataagggtgacttacccagtgcacatatcaatctctttacattgcctgaaatgtttatttttaaaattataccaaagaaagatgtgtttggtcgggtgcagtggctcacgcctgtaataccagcagtttgggaggcagaggtgggtggatcacctgaggtcaggagttcgagaccagcctggccaacatggtgaaaccctgtctctactaaaaaaaaaaaaaaaaaaaaaagacaaaaattagctgggcatggtggggcatgcctgtaatcccaattactccggaggctgaggcaggagaattgcttgaacccaggaggtggagtttgcagtgagccaagatcgcagcgccactgcactccagtttgggcgacaagagcgaaactccatctcaaaaaaaaaaagaaagatgtgtttaagtatcacccttccttaaaactgcaaatatttctagagagaccacaaggctagcagccactcacaatttagtaagctcatttaataatctgacttttttttgcatattaccccagacattcacctgtttagatactgctatacttacatttaagaaaacacttggttaataacatattcccccctcagattcttgaggagtgacatgttcaggcaactcaaagtgctggcaggaataatggcagccaaaggagaatccagaggcctaaaagccagacctcttggggctgagagctgaagtcctgttgctatagataagtgcaaccttgagaaagattccaggacttttgtttctcaggcccatggggcaagcaaacactttctactaggggaagaaaaaaaaaaaaaagaaggttcaaagagcctcaatgtgagttacccttggaagctcaacagattagggaactgttaaaaaaaaaaaaaaaaaaaaagcagaatactagcagccacagaatctagattctattccaaggtctactaataatttgattgtgagatttgggcaaatcaatttttctgagctttgattttcttcaactcaatgcaatgaattgcaataaagggaattggaaaagatgattccttaaggcctcttccagccctataattctaagcttttacaaatgcaagtcttattatttataattaggcatgtaaacttgaaaactccttttctgcaaattttgatggaacatctttgctcatgtaattcatttttatctgttgtcttcacatgaacctttccctctatctgaattctactggctaatttctttgtgaaactttttgtaccaaatcccctttggtttcaatacctagaattataataaaacactttccatttttcaaaaccattatgactggtagagcaccccatcaactggcaaagtcctacttgagtcaattaaaggcaacactgctgagctctgattcttgaagggctctaatgcttggaaatgatttatatatactggattctgaatgacatcaggcttaactgccaagttgcatcaaacaaataatggtactaagttggccatatcgtgagtatctctaaacagtaaatacgtagagcatttagaagagaatctggaacataagtttcagtgagtgttaacttattcttcttccatactgccctattaccgtgctatattcagtacaagccttgcgtagatgaacagcagagtatggaaaccaagattatggtatttttaaaattgtgtgcctaaatattttggaagaaagtgagttttagttcaacaacaaaacccaacccagaacacatgcaaagaccattttaaccaaaatcagggacctctgaaacactgacttgctgcatcctgaaatattgttttagattatacaacagtcagcatcaatgttaaatagtttagccatctggagagcaattaaacaggacataactttctgcatttctggtgactgcgagaatagcagcattgcttacctacacatgcaaataaaaaaaaaatgctcttctcttcagtttgggtcatatgttgaaatacgactctacagcaaagccatacactatccttcaatttccagtgaacctgaagtggcaaccactcctaatgtaagtgtcatgagctggcttctcctgccacctcccttgttttggctgctggggagaatgctgcagcataggacagtaaatggacagtgcatgtctagttgctattctcaagcaaattgttgatcactcccatttcaataaccaccgtctcacccaagttaggaagagatagtatccaggtgtatctgaaccttaacaaaattatagatctgacataattaacctttgtgatgaatttcttaaatggttaatttacaggacaaatttcagcaatctcaggggaatatataattgcttcattctttatcttttggcaagggtaactacaattcaatgattttttacactgaaaaaccaagatgatgaataccctcacaaaggatattgtgatgactatgccctgagctataataaattctcatcataaaaaacagaaattgagaggagtaggggatggtaagacaaaaatactgacccccccccgcaaaaaaatcctcgcattgctatccaaagatgtctgtaacatattcttaaggaaaaaaagctatttacaaaatagaagtagtatgaaaggtattttaaaaacaaaaatgaggtcaatctatgtgtttatatacacaagagaaaaagtctgaaaggagagacaacaaaataataataatgtacaaatgatagattctggatgatttttaatttaaaaaattgttttcttcaatctttctgcttaaatttataattgctaagtttataacagcttacatatataatgcattacactatttccctctttttattgtattgcttttataattaaataaaacaataaacctatttccttggggagggtgttggggggggaagcataccttgtttatagtctcagagagacctcaagttaagctatgttcacaaattgatttatggaatatatcactcaatagtttttggactagaaaaaataggatcagtaagtggcagtaagcattctggatagacaagttgtgcctttctcaataaatgggattcaggagtactgtcagttagcacttgacaggctgaatagactcaacagagtcgtagatgtttgactagtacagcagaccactctaatttgagcaaaggagtgcctatcctaaattaaaatacaagtaaatttttttttttttggagacggagtctcgctctgttacccaggctgaagtgcagtggcacaatctcagctcactgcaacttccatctcccgggttcaagtgattctcctgcctcagtctcccgagcagctgggactacaggtgcccgccaccacacccagctaatttttgtatttttagtagagacaggatttcaccatgttggccagactggtctcggacccctgaccttgtgatctgcctgcctcggcctcccaaagtgctgggattacaggcgtgagccaccgcacccggccacaaggaaatctttagaaaaaatgtaaactataaggtaacatggctcaattaaagctcaagtcagcataatatgattgatgtaataaggtagtatggttgcattttaattcacttgaaaaaggttgctttataacttaatttgcttggtatataaaaactgtgaaggccattacagatttgtaatcttcttgcaaaaatttgtcctcaggtgattttaatgatggatttactacagtgtggaatgaaaaacatgtccatcactctatttggaggtgaataacacggcacccctcagcctttactgctttgagctgctagcaaagaaaacagtcatgtgtgttcatgtgtgtgcatgtacatctgcagtgctgatggcattaactatgcacaactttactgcgctctttcctccacccccaggaacaaacagcaatgcatgaagtagtagcaaaggtaaaacactcttggggaagaatgaattttcatatacatcttgggaggaacaaaagatggatttagtctcttttgaaagagctttggaatttgaagggatattgtcaaaatttctttttgagccacaaaaactcttatcagtgaaaatatcttacagaaaaatactgagagggtgctgaataggccgataaaggtaaccagagcaggtggtgtcactctttacttcataaaaatgaagcacaaactatttgtgagacgcatataaagatggaaagatttatattgccaagataaggtatagagggactaaagagtggcaccctcccatagagaccaataataatgtctaacatttgtaaagcactttatcatttacaattggatttaagcaaaccatctaattccaggtagattcagtccccagtgctcagccagagcttccaggctggcagcctcagtggagaaacgacttctgaagaacacagggcacagcagcagtggccaaatgaggggtgaatctactcacccaccacctgggcacgaactacccagatgagccctactctgcatgctgattaaaataaatgagggctttgataaagccatcgctaaagtctctgaaaggatggctctctccacttcttcctatcaaactaggactgggtttaatgtagacaatgatgaaagggctgttgcaataagcacaccaactcataggagttctggaggaagcttctaactcagttttttgaagggagccttttcagtactgccaaatgtgtaaggctttgcttatttgtgggagggatggcaatctgttctagtgagctggaagttctttctggctaagggggtagcgaagagagagaaatggcactaccaacaggacaggtgcagcaaaaactaagcaaattgataatcttaatttttaatttagaacagctgatacattggttcataaactaactactggtaacatttgtcaaaaaggtttcaggaaaattcagtgaactaaacaaaagtataaaattgcaactgaggctagatgcagtggcttacgcctgtaatctcagcactttgagaggccgaggtgggaggatcacttgagcccaggagttcgagaccagcctgggcaatatagtgagatacccatctcaacaaaaaatgaatgaaagttctatttttaaaatcgcaactgatacaacttgaaagaaataggccacaaattcaggaagatggcttaaatatgaagtttaattttatattggctggtggattcatttcatgaacagtttgatatcctactatgtgcctggtactgtactaatgaaactagtctcgttaggccacagttatacatgagacactaccaaaaagatctaaatcaaaattcctttattcaattaatacatataaaaatgtttgtggtttattttattattttttgagatagagtctcgctctgtcacccaggctggagtgcggtggcttgatcttggcacattgcaacctccacctcccgggtttcagcaattctcctgcctcagcctcctgagtagctgggattacaggcgtgcgccaccacgcctggctaatttttgtattttttttagtagagacggggtttcaccacactggccaggctggtctcgaactcctgatctcatgatccgcccgcctcggcctcccaagtgctgggattacaggcgtgagccactgcacccggccatgtttgtggtttaagtatcactaagggaccatgtctaaacaagtctaataaataacttttacatttactttttttgcagtgtttttaaattatagttgttctttttaaaggatacattgtctagataaataacttcataaagataaaggccatttattggtttttgatcactcagaaggttaatacgtaagttgcaagaccttgggccaaccatgtcacttctttgcccctcagtttgcttatctagataagaggtttctgtgttttatcaacaataagtcctatgattagaaatatttaaatgtgcagctatatacatttttaattcacaattgtgagatacagtaaaaaatagtttttttagctacaataaaagagtaataaaaaaactgattttacttttgaataaaggtgcatggtcttggactactgaagcaatgccaaatagtcatttattgatcactgactcatttatttgtttaaacaacaattaggttcctgaaaaagtagcagacaatttaaagcgcttaagatgaaaattttcagtgaggtgtggtagctcgtgcctgtaatcccaacactttgtgaggccaaggtgggaggatcacttgaggccagaagttttgagactagcctgggcaaaacactgagatcccatctctatgaagcaattttcttttctttttctttctttctttcttttttttttttttttgagacagagtctcactctgtctcccagactggaatgcagtgggacgatctcggctcactgcaacctctgcctcccgggttcaagtgattctcctgcctcagcctcctgagtagctgggattacaggcgtccaccaccatacctggctaatttttgtatttttagtagagatggggtttcaccatgttggtcaggctggtcttgaacacctgacctcgtgatctgcccaccttggcttcccaaagtggtgggattacagacgtgagccactgcgcctggccgaaaaataattttttttaaagataaaaattttcataagaaataaagaaaaaggagacgttttccagcagattttttaaaaagttggttgtgtcaagtattttgcattactataaaaactataataaatagttgctgagaattgaatacttggtcatgaaacaaacaagcaacgtaaaactgattatcatatagcagttagttgctttattttccaccttcccccagtatgggaattgctgaatatgaagtctgttgtactcaggatataccattctcagtatgttctttacctagcgacactgccgcatgttgttctgacagaattctgagagaattatccttgccattttagtgttgggcccatttttattcaatgtggctgatgagctccattttgctttcactgcttcttcatctggagaccctctcagtgatgtaaactgaaagactgttgttggctagcacactgccttctattagtggctttcaatacacattgtgacacagtataaatacatgtgcatatataaaactacatttttttttttttagatggagtctcgctgtgtcacccaggctggagtgtagtggtgtgatctcggctcactccaactgccacctcccaggttcaagcgattctcctgcctcagcctcccgagtagctgggattacaggtgcccattaccatgcccagctaacttttgacttttgtatttttactagagacggggtttcaccatgttggccaggctggtctcgaactcctgactttgtattcccaaagtgctgggaatacagccgtgagctaccacgcctggccaaaattaaattaaaagtttcattatgtaattttctattgcattctattttttttttttttttgagatggagtctctgttgcccaggctgaagtgcagtggtgtgatcttggctcaccccaacctcgacctcccgggttcaaacaattctcctgcctcagcctcccaagtagctgggattacaggcgtctgctaccacgcctggctaattttgcatttttagtagagatggggttttgccatgttgtccaggctggtctcaaactcctagcctcaggtgatccactggcctcagcctcccaaagtgctgggattacaggcgtgagctaccacgccaggtcctatggcttgaacccgggaatcgcttgaacccaggaggcggaggttgcggtgagccgagatcgtgccattgcactccagcttgggcaacaagagtgaaactccatctcaaaaaaaaaaaaaaacaaacaaaaagtattgatagtgattcactaaattgatttcaccactccccaatgaaaaggatgtgatctgtggtttgaaacattattcaatatcatgctgaaaaatgttatgtatagttcataccttgttagtccttgtaattacacacaaggtcttccaaatttttgatgcagtttaaacattgttactctaaaatatatttttagaggtatttatttctttatcactttttaccaaaaacatgtaaatgaagtgaaggtaaacagagaggcaagataaaacagaatcattcttgggtactatggagtatattctattagggtgcatttcaatcttgtaggcttgtatcaataatgctgatgcttagcttcattttttttgtttttgttttctgagacagagtctcactctgtcgcccaggctggagtgcagtggtgccatcttggctcactgtaacctccccgtcccaggttcaagcaattctcctgtttcagcctcccgagtagctggggctacaggtgcatgccaccatgcccggctaattttcgtatttttagtagagacaggttttcaccgtgttgcccaggctggtctcgaactcctgacctcaggtgatccacccacctcggcctcccaaagtgctgggattacaggtgtgagccacggtgccctgcctgatgcttagcttggatcctgttagattcctgaaaacaaattggcttagataacatttggccaaagagctaaaaatttcagtaatttcctaggagtcacagatacatcttgcaaattccagtgctgccatgtcttttgggtaacacagttcactttccagctcaagcagttcctcttcaaattgggccacactaaaaggcaggtgtttgtaattcagagacatcccaaggtttgtactctaaaggcaggcacagaaataaaatcatgattcgtgtgccttaaaatccatgcaatttgactaaagctgtaattgtatttcttccaaataactctgaagctcttcaaaatccacaaatcaatggaattctaaaaataactgatgctactagtactgtgttctaaaaaattaagtaatcttttttttccttccttcaaattatcaggtagaaatttgggggccgggcacagtgactcatgcctgtaattccagcacttgggaggctgaggtaggagaagcctctgagcccaagagtttgagaccagcctgggcaacatagggagatcctgtcccagaaataaataaattaattaattaacaataatagaagaggccaggcgtggtggctcacacctgtaatcagcactttgggagaccgaggcaggtgaatcacttgaggacaggagttggagaccagcctggttaacatggcaaaaccccatctctattaaaaatacaaaaattagctgggtgtggtggtgggcgactgtagtcccagctactcaggaggctgaggcaggagaatctctagaaccttggaagtggaggttggagtgagccaagatcatgccactacactccagcctgggtgacagagcgagactctgtctcacaaataaaataaaatgaaataaaataaatctgggattggccacattgtacccttggatcaaataatggataccctgggccaggcacagtggctcatgcctgtaatcccaacactttgggggctgaggtgggaggatggcttcaggtcaggagtttgagaccagcctgggcaccatagagagactctgtgtctacaaaaacttcaaaaaattaacaaggcatggtgtcttgcgctgtagtcccagctactcaggaggctgaggtggaggattacctgagcctgtgagttcgaggttacagtgagtgacaatagccccactgcactccagcctggggtacagagtgagactctgtctcattaaaataataatacaaataaataataataatggacatacttgggttagaaatactccaatctataaagatatacatacaattggcttttttttttcttcccctgagacaggatctctatcacacaggctggagtgcagtggtgcaatcttggctcactgcagcctccacctgccaggtttagcaattcttgtgccttgacctcccaagtagctgggattacaggtatgccccaccacacccagataatttttgtatttttagtagatacagagttttgctatattggtcagtggtattaaactcctggcctcaagtgatctgcccacctcggcctcccaaagtgctgggattaggggtgtgagccaccactcctgtcccagttgggttttaaactggtatttctcatgcttcatgcaatgcacacacaaaaattttttttgaattaacaatactgttttagtatgtgacttacttgtgtaaatcacaactgtttcaatataaatgtgaattatcactttgctcaatcaatattatcagaaatttacatttgtacattaccttatagcctttaaagtacttgaacaaattaagccatatataaaattttcaacacaaatccgccataaagatgagtttaccaatttggggtactgctttagattgctgaaatatgcacaaaaatctttagctctctgattttatataagatattggcttctctgttactttcctgactttattaacaatttccttgattataatcattttgtttttcttcatgtgtcatgccattttcaggatctggttataagatgcaagtttagactctttcctacaacatctacaacatttggaaccatagaatattggaaccagcaaggatctaagagatggacatgatgctgcctttatttttttagaaaactaaaaaaaaaaaaaaaaagttgcttttgcttataagttgctaatttaaaatgtttcaccgggcacagtggctcacgcctgtaatcccagcactttgggaggccgaggcaggcagatcacctgaggtcaggagttcaagaccagccatagccaacatggcaaaaccccatctctactaaaaatacaaaaattagctggatgtggtggtgggtgcctataatcccagctacttgggaggctgaggcaggagaatcacttgaaccttggaggcggaggttgcagtgagctgagattgtgccactgcactccagcctgggcaacagtgagactccgtctcagaaaaaaaaaaagtttcatgaagcccctatcaatgtttgtattgaaatatgtattccaatatttagaaactaataaccgtttaagataccataaattccaggattgataactgcaaaattgttggcaaaaatgtatcatggttctttgttggtctgtcagttttctactttagtaaagcatgaggattttgcagtcagattgcctggatttagacagcaactctaccatttattagcagtgttaccttgagggaaattacttatcctttccctgtacctcaggagacattaaatgggttaatatagataaagcacttaaaacagtgcctaccgtatagtaagccctcaaaaatataaattgttatttctaaaatatttgatggtaattttaatgattaaattttctacaactataaagtttctaatttcagtgataaaaatggggaattaagatatcagatagactgaaataatagatggatgaatgaatgatctgaatttggaattctgagaggtaaaatgaagagttcaatgttaaatggcttattgggggataaaaagaaacaaaagaaaaaatgaggccaggcgtggtggctcacatcagaaatcccagcattttgggaggccaaggtgggcggatcacctgaggtcaggagttcaagaccagcctggccaacatggtgaaaccccacttctactaaaaatacaaaaaaaaaggaaaaaattagccgggcgtggtggcacatgcttgtaatccccgctacttgggaggctgaggcagaagaatctcttgaacccaggaggcggaggttgcagtgagctgagatcgcaccactgcattccagcctgggcgacagaacaagactctgtctcaaaaaaaaaaaatagaaaaaagaaaaaatgaaagagaaaaaaagccaaggctaggaattcggtccacagacttctactttatggttctttccacttctctttgtagctttacatgtcatctctaggaatgtaaaatacataagtgctatgtagctcaacacattatgaaaatataagtgatccccaagagtgtagctaaaactgttattagtaaacagttactctgatattctaaacagggaaactatcctttaaaaaccaaagacttgatttgcaatatagttttggtgtttccagatttctgcctgactttacaccctgaaaatggtcccagaacaatgacaattaagccataggaatgacaacaaacaatttaatgaaatttccagaatgcttaaaaagaaacttgcttggcacagccatactttccaacaaacccactttaaagttttcacagtttacaatatcagaaatgacctcagggtcaggcatttgtcagttaatgacctgttgggctaatggccttcagctttgccttaggcacataagtcctccagtaggtcattagctgccagaaaagggctcttcccaatcactatggctaaataaataaaatttgctcctgggctaagaccctataaaccaactttggcttagactaagtaaattttttgttgcgtatttacaactttaagaatttaagaaaatgatggaaatgctaaaaccaaaattacattaacatgactgagctatatgtggctatcaatgaggaaagtagtcacatagactcttggatgagcttaaattttcttttgcttatggtattcaaattcagttgaacctcacatcatggttggccatgagaaatagaaatatattgactatggcaatattatatataatacatttagcaaccttgatctttgtaaatcccatttcctaccttccagaagtaaaattaattaaatcagtcttcccccttcatttttttttttttttttttttttgagacggagtctggctctgacgcccaggctggagtgcagtggcgcaatctcggctcactgcaagctccacctcccgtgttcaagccattctcctgcctcagcctcccgagtagctgggactacaggcgcccgccactatgcccggctaatttttgtatttttagtagagatggggtttcaccgtgttagccaggatggtctcgatctcctgaccttgtgatctgcccacctcagacacccaaagtgctgggattacaggcttgagccatcgcgcctggccccccctccattttcatggacatttgctagatctccaaagccagagcgagaaaaaaaatctattttcaagtttgagtgattcagtactcttcttttccctttctaatggtctcacctgaggaactttctgagttaggagtttactaagtactgggtggatagacagctgattcctgccttcgcatctgcagctgcctatctcttctccatctatcctttcttcactccagcaggcttgtatactgtgtctctttctgtcccttcccaaatctcatgttgaattgtaaaccccaatgcaggaggtggggctggtgggatgtgtttggatcatgggggcagatcccttatggcttggtgctgtcttcacaatagtgagtgaggtcttgggagatctggtagtttaaaagtgtgtggcacctccttcccgttgctcctgctttcaccatgtgacgtccctgctcccactttgccttctgccatgattgtaagcttcctaaggccttcctagaagctgagcaggtgcaagcaccatgcttcctgtaaagcctgaagaaccataagccaattaaacctcttttctttacaaaattacccagtctcaggtatttcttttctttcttttttttttttttttttgagatggagtttcactctttcccctaggctggaatgcagtggcgcaatctcagttcactgcaacctccgcttttgggttcaagcaattctcctgcctccgcctcccgagtagctgggattataggtgcccgccaccatgcccggctaattttttgtatttttagtagagatggggttttggcatgttggccaggctggtctcgaactcctgacctcaggtgatcaacctgcctgggcctcccaatgtgctagaattacaagtgtgagccaccgtgcctggcccgtctcaggtatttcttttctttcttttctttttttttttttttttttgagatggagtctggctctgttgcccaggctggagtgcagtggtgcgatcttggctcactccaagctccgcctccctggttcacgccattctcccgcctcagcctcctgagtagctgggactacaggcgcccgccaccacgcccggctaatttttttgcatttttgtagagacggggtttcactgtgttagccaggatggcctcgatctcctgacctcgtgatctgcccgcgcggcctcccaaagtgctgggattacaggtgtgagccactgtgcctggcctgcctcaggtatttctttatcgcaatgcaagaacagcctaacacactgttcacaactcggttaatttcacctcacgtaatctctaaagtgtatatacatcctcttcaatcttcatcctccagttttctattctttctccttttacttattatttcagaaaaattgccactcaccttcttgacttctactttctcctttcaagaagacataaaccaaggatcttcaagttgagaaacatcagaggaaagcaagatttctctcgtgctaagaaaaaggaaaattgggccaggcaaggtggctcacacctgtaatcccagcattttgggaggcttgaggcgggcagatcacgaggtcaggagatcaagaccatcctggctaacacggtgaaaccccacctctattaaaaatacaaaaaattagctgggcatggtggcacgtgcctgtagtcccagctatttgagaggctgaggtaggagaatcacttgaacctgggaggcagaggttgcagtgagccaggatcgtgccactgcacttcagcctgggtgacagaatgagactctgtctcaaaaaaaaaagaaaaaaaaaggaaacttggctgggcacagtggcttacgcctgtcatctcaacacttggggaggccaaggatcatttgagcccaggagttcaacactggcctgggctagatagtccggcctgggcaaggtagtgagaccttgtctctattacaaaaaataaagaaataaaaataattaaaaaaataaaaaaggtaatattagaaatgaaatatgcattaaaaaaccagtgcctaccctcatcctcttattaaaccaaatttccctttatatgtcaacatttaaaaataatttaacaaatatttcttgttcagtttgttttcctattttatttatttgcaggtattgtagaatgcagatttttttttttctttttaaaaagggtgtccttggccaggcgcggtggcttacgcctgtaatctcagcactttgggaggccgaggtgggtaaatcacctgaggtctggagttcaagaccagtcttgccaacatggcgaaaacccatctctattaaaaatacaaaaattagccaggcatggtggcaggcgcctgtaatcccagctactcaggaggctgaggcagaagaatcgcttgagcccagggggcagagtttgcagtgagccgagactgagccactgcactccagcctgggtgacagagcaagactgaaaaaaaaaaaaagggtgtctttgaatgccaggcatatggaagaaacatgtaagctgctcttgctctttttccttgttgttaggtttctggtttgatactcagagaaatgtcaatttcacctgatggcatttaaccttcctgtgccaaaaagctactacattccattgtcttgtggcttcaaaatgggcaaagttccaggttttaatattatttaaaattcgtcttatttctagtataatttgcacacactaatcatttattactttcactttaaagatcaaggaagcatgaccagaaaatggatacagtctctgtttaatatgtgactatattagcaaatcagaaaaaaactgaagaagctaattttgggattctgaaataattttatgatggcattttgacttttctaattaattgatatggagatagtctcttttactgttatactatatgacaccccacttaccaccttctgcatccctttaccctagtcatgcaaatctacacttgagtgggttacatgtataaaaaatattaaccttgggtgtcaaactaaagagcctaaaagatattaaataatttccacaagtaaaatagtgcaagcaaaactataaacactatcataataatgcctattttaaatgcataagacagggaaaaacttaatacatgtttttaggtttcaatttaacatgaatttggaagtaaaattactataacagataagacaaacacaaatagacaatagcatctttattaaactatatagatggtgtaaagggagatttatatgcataaattgagcatatttgtacaaacaaaatacttcattttaaacaacatatttacgcctttaggaaaacaaagttaacataaggaaatacatcagctatgtaaagagtacatctgtgccactggttatccggaagtataaatcactaatgcttaatagaacaacctccaggagtgacatcatgacaatgctcttgggtgtttagacaagatccaggctgactcacagtctcccatctgatatatagcaataggtccattaaatgaaaatgactacaaagaaaaaaaaataacgtgataaattccattctttaaatactaggcttatcattatatatgtaaagtaaaagacttttcaaaaacaagatgacaggtagtaatccacacagtcttatttgcactgtggcttaatcctaaatacaaacccagtctaaataaatacaaagaccagaggaagcctgttaatggccagctagatttcgaaattatagtacttctccacttcatgatttcccttccaattagttagcatgtctcactgatagcttgctgctcaaacactaaaattttagattctggcatgaccacatcactacagcatccagtgatgttctacatggacacaatatagagcaacttatcccaatggaatcaggaaatttatgatttaaaaagaggcattctgaggtcttttagtccaggtctttgtacagtgaagtactaaaataaaaacttgcccttatgttccataattgaaaatgaatgaaaacccaagcattaatttttaaattccctcttgaattcaaaatcttgttaatttgcatttatgtgactacagctataatggtaagaagacaattaccagaggattaataaacaatttctatacttgaagatatttaaaaatctaagtgttacctaaggcaattaccttgaagacccctaatatcttcagggaaaagccaaagggaaaataattgactctgctaattttacccttggcaattataaaacagctctgaatttcatttgactgcagaacccttcatctaatggcctgccccatgagaagtacagagataaacacatcatatagaaattcagacaagaatccagtagcacaagaaaatgagaaattggtagaatgaataagtcataaaaaattaaagttgttacaaatatgccaactttaattaccaatatacatcctcaaagaaaaagcaggctgtcactgtgaaaaaacagtgacatattataaacagaaattctgtattaagttttgcctgtttcctcttgctgtggtatctatttatgttgctattgttgacaaattttctttcttataaaagaaaactaaaacatcattaaatagaatctaactttaccaagacattaagcatatgtagagataagaaaacttggccaggtgcggtggctcacgcctgtaatcctagcaccttgggaggctgaggcaggtggatcacctgaggttaggagttcaagaccaggctgcccaacatggcaaaaacacatctactaaaaatacaaaaattagccagatgtggtggtgggcacctgtaatcccagctacttgagaggctgtggcaggagaatcacttgaacccgagaggcggaggttgcagtgagccaagatcgtgccactgcactccagcctgggcaacaagagcaaaactgtctcaaacaaacaaacaaacaaacaaaacgcaaaaaacttactacactactacttcaaagaaatatttatcgccacctcctccttctaaaaaaaccatagttactattatacttaatcaacttaagcttctgggagctcatttgataaaataagtcctcttctgagatataacttcactttccttaaattattctgatgaaaatattgccaagtatttaaatgaaagaaactggctctgaatatgggagatttgctttatcagagggaattcctgactttcaagaactttagtaattcacaatctcctcagtttaaaatactgttcacctgatttggaaatcatctattacgattaaaagagagctactaaaagccttgatttggagaagatcaattacagaccctgggcatggttcttaaggtctttcacaaaaagtgaacccctgaggcatttttttttttttttctgaaattgacctggtagagccttcaatgaccctttgaagaacaaggtgcaaaagattcacgtttgagattaacaggagggctgcacagaataaagccttcaattcaacatacaactatcaaattcagaaaaaaacatatcatagcctaaaaaggaaaaaattcctcaccagagaaaggttgataaaatgcaaatttaaaggtgtaaacctgtgcagagaccatgaagttatgaggctcactgaaggggaaggaaatgccagatcattcttatttcaagaagcttcaggctgaatagttgcttggatatgctaagtttttctttttctttttctaaatcaagtagtgctactgaaatccagtgcctaatggagcagatggtggaggtcttagactctggaacatttatagtgatgcttctgaatgcaaaacaccaagagtggatttcacaggctgtgaatctgatttgattttgatgggagtaaagcttccattttcactgtacttgaaccacattgaaaaaaagcatgtgtgactgacacaagctagttaagaaaaaggaacatgttaaatattagtcccataaagggaagcagtttaaacaagtgattatttgtttgtatcatttaacatgattatgtttgtatacaataccaccgtttgaaccttatgtaagatttcatcagaatagttcaaagttaaaacaaatgattacagaaaacaaatagaaatttgtccaaaggcaacgagtcttggttttctaaggtggcaactataccgaggcaaattaccaaaatgtggacctaggtactatcaaggtccagaatatctcctcccctcagctttgtaggtctaatccatgaacggccagcctgtgaagctagagctggtcatgtgcagctcaaggtgtccagacactatgtcagatctgcactttctgaggcctctttcttctctaaacaagggctaagttttatcacagaccactgcaaatatggtgaaaaggagagatggatgatacagtttgtgagtcccaggggcaaagaaccactcaccttctgttaacatgtgaattccagtgaaggagagaatttagtgggacccgtcaaagtatactatatgcataaaggagagagacatttgagatgaaataaaatagaattggagagagacatcagattctctttcttttttttttttttttttgagacaggggctctattgcccaggctagagaaacagtggtgcattcatagctcaatgcagtctccaactcctaagctcaagaaatcctaccacctcagcctgctgagtagctaggactaacagcatgcaccaccatgcctgttttttgttttttgttttttttttctgtagagacagggtcttgctatgttgcccaggctggtctccaactcctgggctcaagctatcctcccacctccatctcccaaagtactgggatgataggcatgagccaccatgcctgaccaagattctctaatagtctgcttaataggatcaattcattttttactttagcttttaaaaaaatatgaatataaattagatattaaaggtaccatactactttctcccttaaattccgcaggtctacctcatgagtatatgtgctagccaaaaatgcaaacacatgatgagaaggtagggcagaatgttacttgtctcctagtatcttttatctgtatcttccagatttttggctggatccatgatgacctacaataaaaattacattttctagcttcccttacagctaggtatggctatataattaaattctggtcaacaggatgtaagcagaaaaatctcatataacttatgagaaatgtctttaaagtgtgaatactatataatttatcatgcaaactgggacacaagagtaaaaagaagcgctgaaacaactaaaattttatactttttgaaatatgtatttatttcaaaaacaaacagctgattttattatattgaaataaatatgtatttatttcaaaaacaaacagctgattttattatattggtggactcaacaggttctattcaaaaactgttttcaaaaataaaatttcaaaagaaataaaaataacatacatgtacatacaatagaacaataacttctttatactgattatctgaatatttaaaaataatgagaattattattgatgtatatctacatagtttaatccatttcttagacatatctgtctctaatattgtgtcactggcatttttctgaagaatgtgttcattaaaatacagtatttaaaaataaaactgcccgcaatattcttcacagttgcagtttatggttagtttgaaattactgatactttcaattatggagaaaattctctttctacaggttctaagttacctgataagttcagagtaaatttgctaaatggaggacataattctaattttaaaaatgttgaacagtataaatatttcagcccaaatatttttagaggcactctctttttgcttccatcagagtatcttactttaacaaatagtatttttttttttttccatacggagtttcgctcttgttgcccaggctggagtgcagtggtgcgatctcggctcactgtgacctcagcctcctgggttcaagcgattctcctgcctcagcctcccaagtagctgggattacaggcatgcaccaccatgccctgataatttcagggtttcatcatgttggtcaggctggtctcgaactcccgacctcaggtgatctgcctgcctcaacctcccaaagtgctgggattataagcgtgagccactgcacctggcctaacaaatatttttataagacaaaacttgtcaaataagttgtctctatgattcttttcaatgttttgccaaatttagatggtgcaaaatctaggccttctcaatctcatttcgtgtgtctgtgtgtgtgtgtgtgtgtgtgtgtgtgtgtgtgtgcaatttattcaaagtaggagcaccaccaagattcttcctgcaaggtgagacatttcaaatcgcaactacagaactgaaaattttaatcttgtatatcgtttgagttgttactgtttatatcattccttctttgcttttgtcaggaaaaattctaatggaagttttgttttgttttcattaattgtaattccctaaaagtctcatgtagtgttctgtttattgaatacttgatttaagattctcaagtgatgttgaacgaaatgctgccaattattattagtagtagtagtagtagtattttttgacacagagtttcaccctgtcacccaggctggagtacagtggcgtgatctgggctcactgaactgaaacctccacctcctgggttcaagtgattcttgtgcctcagactcctgagtagctggaatcacaggcatgcaccaccacctctggctaatttttgtattttcagtagagacggggtttcactatgtttgccaggctggtctcagactcctgacctcaagtgatccgcctgccttagcctcccaaagtgctggaaatacaggcgtgagccaccgtgcccaaatgccaccaaacttttgatgacccatttagaataaagttcaataccactgttgggggcacagattgatttataaagatttctaaaatctgatcaacgacagacaacaaagagaaaaggcacatactgctctgctgaagtgtattattattattttttttttgagaccgagattcgctcttgttgcccaggccggagtgcaatggcgtgatcttggctcactgcaacctccaccacccaggttcgagcgattctcgtgcctcagcctcccaagtagctgggattacaggcatgtgccaccacactcggctaatgttctttgcatttttagtagagacgggatttcaccatcttggtcaggctggtctcgaactcctgacctcaggtgattcactcgcctcagcctccgaaagtgctgggattacaggcatgagccaccgtgcctggcctgaagtgtatttttcatctgacatccaccgtgcctggcctgaagtgtattttttatctgacatcagttacaactcccaaatcatatagttcagtgactgtgactattcagatatttgtaaattttgatgtaacaatagcttctattaaaatagaagacttttggtgcttgtttagatgtaatgatcaattgtgtgtgtgccacaaccaatgtcaactactccacaggttgcttaacgtagtaaaaacattgtttttaccacaacactgtgcttcaccaaaatttgtacttctattgttactataaactaataattttattttctatattgaacttttaaactgaatttccaatctcactcacaaaggctttatgtttaatagaatatacttccaaaaactttaccttaatcccatgaatgaatggaaagaaaaaaaccaaaccatttgtagaattaacttaaatgatttacttacttgaaatacctgatgacactgaactaaaactggaattatttaactgctttcaaagttcttctactgacaatgatgcaaaagaactattgcttcccttttcctatatacacataaacacttgtagttgataatcagtgcaatcacttagcatagtcatttctctaaatataagttatgttgcagagtcgtatgcatatataccttctgcaactgcataaagtagatcctgacacttcttcagcagactttactcttcttgttttcatgtggtcaatgatagataccactatggcctccacagtggttggtaaatgtcaacaaacattttgttcaagttattaatatacattccttattaactttcttaagaaaaaaaatcaatacttaaaaaaatgaaacacatacttctagttttttcagtttactgctgccaaaaggatttattgcaaaaacaaagtattgccaagcaataaaatagttatagatttacactgtacaagcaagtgtgctcattctacactctacttgctccctagcagagctgatcagccttgatttcccatatatattttacagacacccaaacctataatttactgtttcccactgaacttatcaactggtatctggcagctttgtgactcttgcaggccatgcatgggctacagtacaattgggtgacacactacacagccagcttctcccaccacctgatacaggaaagagttagctgcccctagacatttgtgtctgagtgcactttactgtattagcaattgccctgcattctgtccttgattgggaagtgttagttgtgtctgaaagggctgggaaaagaggtaagttatttctggtatctttcagatttcctaacaacttaaaatgaagctgggcacagtggctcatgcctgtaatcccagcactttgggaggccaacacaggaggatttcgtgagcccaggagttcaagaccagcctgggcaacatggcgaaaggcaaaagcccgtctctaaaaaaaaatacaaaaaattagccaggtatggctgtatgcacctgtggtcccagctacttgggacactgaggtaggaggattgcttcaaccagggaggttgaggctgcagtgatcacgccactgcactccagcctaggttacagagtaagaccctgtctcaaaaaagaaacattaaaaaaaaagaaacaaaaaaaaaaaaaaggacaactgataatgagaactctctccactgtgtaagggtctcagaatactattacattacattacacaaaaacaaaaacagaggctggaagtactaagtggggatctaccaaattcatcccagcttattctaatataattattagtaataattctctgttaaaaaatgaaaaattcaggataaatgctaaatcagatgggatcccaggatagctggcttacactgagactctcctttagcaaactaggatgtacactgatccaaccttcaaaggaaggagatctgccctttttttgtccttcctcgttctattgactggagggaagccataatggcaaatgcctcgggccatgatgtggtaagataaggatggcaaaacagtaagacagaaggagcctggatccctgactttgcagactcactataccaacttttgactgcctactcctagatgattttacatgagagaaaaaatacattcctatcttatagggcactgttatcttataatcaaacctaatcctaactgatataacaagaaatacctttataacctttccagaaagcagattggcaatatgtatcaagaatactaaaaatgtggccaggcgtggtggctcatgccttaatcccagcactttgggaggttgaggtgggaggatcgtttgaggccaggagttcaagactagcctgggcaacacagtgagactctgtctctataaaaaatttaaaaattagccagccagctactcaggaggctgaggtaagagatcgcttgagcccaggagtttgaggctgcagtaagctatgattatgctactgcactttatttattttttttatttttatttttatttttgagatggagtatcactctgtcgcccaggctggagtgcggtggcacaatctcagctcacttcaacctaccaggctggagtgcagtggcatgatcttggctcactgcaacctctgcctcccgggttcaagcgattctcctgcctcagcttcccaagtagctgggattataggcacgcgccaccacgcccagttaattttttatttttagtagagacggggtttcaccatgttggctagactggtctcgaactcctgacctcaggtgatccacctgcctcggcctcccaaagtgctgggattacaggagtgagccaccacacctggcctttaacctgggtgatacagtgagaccatgtctctataacaaaaggaaaaaaaaaacactaaaaatgtttaaccctttgaaccacttctaggtctttatcttaaagaaataatctggaatagggaaaattgatatgcaaagatctttactgaagatctacttatgatagtaaaaataagaagcaacctaaatgtccaacaatgaggaatctgataaacaagtggtattatatctaagtgactggatattatagaaaaagttataaccatgggaagatgctcgcatcataatattatgtaagaaaaaataggcaggattaaaaaaccttatacatagcaagttctcatatatattacaaaaaattacatatataaaggcattaatgaacaacaaaaaaagactacaaggaaatacatcaagatattaaccagcagtgattatctctggatagtgggattataggtaatatttacttacattttctttgttttgaagatttaaccctatcctataattaataatttcatccataatcagaaaaaaaattactctcaaaactctttcctagcatttacactttgcctggtactaacactgccatcattatgttcatcacagttttactgtttactgagcatgtacatgaggggagttggggcagccgggcacacagacctgcagctccagcagccaactaattgctacctgaagccattcaggtacaacaaaaccctgcccaattttaccttggtgttctgtagcagagctagtccattgcaggcatttgctagaagaaagtctccactcaggatagcaattttatttccaaattgcatgtctttcagtggaccatcagatgattgcaactcatttaaatttactatcccacgatgtacaaggagagcaatatgaattagctccgtgatctctgccaaacttctttgactaaaacataaaggtaagatttgttagaatatcaagaacaccattttatcactaatgtctgatttcagttttcaacaataaaatattccataggttgccccccacttttttttttggattatatctttctaatgaatctttaaatagaggtctctctactgagcagtttgggatctgtaagatgttgacaccttccttctctgtaatactcctcactcttccccacaagtcactaggatatcccagacagaagttgaccagtggagggccaccttccacagctccatttagatactgtgctcttggtatactttcctcacgctcataacttcaaaatttctaagactccttagtagtgtctaatggaattccaatttaagtgagaatataatctgtgccagatactagtctaagggcattacatacattatctctctctcttttttttttttttttttttgtttagatggggtctcactctgtcacccaggtttgagtgcaggggtgcaatctcagcccactgcaacctccacctcccaggctcaaataatcttcccacttcagcctcccgagtagctgggactacaggtgtgcgacaccaagcctggctaacttttgtatttttggtagagatggggttttgccatgttacccaggctggtcttgaactcctgagctcaggtgatctacctgcctcggacacccaaagtgctggaataacaggtgtgagccactgctcctagctacattatctcttttaatcataaatgcaaagctatggggtttacagagatgaatacaatatggtttcttccttcaaggactttttaactttcagaataagaatgaagagagaaacctatagtagcaaataatatagagaaggcccctgaggagcttgtagtatagaactatatttattacacgggaatttcagcagatgtttgttccttttttatacttttctgtagtttgtctattttgtacaatgacaaaagtattacttttatagtcagaaaaaatcaacaggtaattactaaaaatttaaacattatcacaacttcatgataggtattattaacgtcttttaataggtgaaaaaattgtgcacacaagtaaaatgattttcccaagagtacacagtaatgtagacctgaaaatctgttggtatctgctacaaatggccccatgtgagtcatgtcttttggtttccaagctcctgcatgatccccttccatgcctggccatgtgacttgctttggccaataggacatcaacaaacagtacacaaggaaagcctgataagtgcctatgcaactgataagcttttcacagtcacaggcgttgcatgaccccaagcagaagaacactcacgtcaatccacagaatggtaagttgtttcaagtcactaaactatatgggtgatttgctatgtagcaacagatatctgatacagaaatggtatatctataagtggagtgtttgctttgagtcagaaaaatgaggctaggaggcaaaggctgaaggaatggcaaactcttagtggaagctggaaagctactcagctgcaagtataaactgtatcttactgaaaagggaaaataggccaggtgcagtggctcatgcctgtaatctcagaactttgggaggcccaggtggcaggactgcttgaggccaggagttcaacatcagttcaggcaacatagtgagaccctatctctacaaaaaattaaaaaataaaaattagcttggtgagagggtgcacgcctgtagtcccagttacttgggaggctgaggtgggacatcacctgagctcaggagttcaaagttatagtgaactgactgcactattgcactctagcctagcacagagtgagaccctatctcaaaaaaaaggaaagaaaagaaaagaaaagaaaaggaagctcagaaggtagagccaagaacaatggagaagagtggattcgagaaccatttccagggaatagaactgagccctaatcaagaaacattccttgctccaagatacagtaggtggcccagatatatgcccagctggatttcagaattgctacagactagtgactgctatgtacctcccatttctccctctttttaatggaagtgacaactgtggttatcttctttctgattcactgttgcatgttggatagacggtggtgtgtggttggggggagggtggataacttgtccttttagttcctaggtccctgactgaagaggggctgcacccatggagccacatccatatcgagacctaacagaaatcatgagatcagggactctgagcttgatgtcataaaatggatgagactggggtcttgggaggtggtctgttttgcatatggaaggaatgtgaaatattggggccagagggcaaactgtggcagagtgttacaccaagttacacttatcagtcacaccctctgatatccaagccatgtatgatctccttgattgatgctgagtttgaccatatgacttgtttggtcaatgggacatcggcaaatgagggacaaacaggcttgataaatgtttttgcattggggcttacactctttgaatgctaacctgagactacaagttaagaaacctaatctagcctcttagagaatgaaaggcaacatggagaaaggtccagctgtcccagtcaagcccagccccctgcacatttaccaggtaaacacagacacataaataaatacaggagaaaccagcaaaggaacagtccagccaaacaacagaattatgagaaataagttggttattgttttaagccaccaaggtttggagtagtttgttacacaatagataactaacagagactccaatccccaatctatttctactagattaggctgccttccacatgtgcccattgaaagcttctatctttcctttttttctgtagacctcatctgtgtcacaaaagctttaaaaaagtttccttgaagaagctaaatttgagcggggcctggaaaggcaagtaagatttccatagctggagaaaaaggacaaaacaagagtagggcttgggaaccccagaataagaaagactacacatcatgacacagagaaggcaagagtagaaaacgtgaccaaaggttgaaaagatcagtttggctacagtaaagggactgtgtggataagtgagagataagaattttggagcttggttatagcaggtgaaatggtctatattttacacatgcaatattttgagatgaaaggatgatatatattttttaataatttaggaagaagattccaaaggtgatacatagaaaaatcttaaaaagtatgtagggaaagtagggatatggggtgggggagctattacaaaggtccaaggaagatgcaacaaaagggcttgacctaggacaccgccttagacatggagagaaataaatatagaataatcaggccaggcgcggtggctcaggcctgtaatccctgcactatgggaggccaaggcgggtggatcacctgaggtaaggagttcgaaaccaacctggccaacatggtgaaaccccgtctctactaaaaatacaaaaattagccaggcgtgttggcgggtgcctgactaatttttgggagctacttgggaggcagaggcaaggagaatcacttgaacccggaaggcagaggttgcagttagctgagattgcaccactgcactctagcctggatgacagagcaagactctgtctcaaaaataaatgaataaataaaataaataaataaataaataaatataaaatcatcaaataatatatgagactcctcttaaaaaaaacagaatggtttaacatctataataatcacataaagatacaattaaaagaacaaattggcattatcaaatgccaaggaaaatctcatgtctaattgatttcctttgttaaaaaaattaagagaatatgtaaagatgacccagtagacatattgtacttgattacaaatttggggagtagagaaaggaaatgaaccagtgagtcaaatagtatctaagagtaaattcatggtttagattaaaatctcattatatcccaaagaaaatcactaagaatggagacttataagacagttgaaaagttaacagaagacatttttttaaagtagaacatttaaaattaccgtttaaaaagtgactaaaagaaaggaataaaattgtattttattactatcctgcgaatgatttctagtttacaaaaccattcactgaaaaaagtccgcattatcacatttcacaaaaatcacataatgagattatgggcaagtataaaagtaaaaagcgttaagcatttggacaagtttttcatgcagttcagtttatgaaagaaagtaataaccaggtaagcaaaaagttgtggtgttttgaattactcaaaggatgaaaatgagtgattttgacatctatagtcataaaacagcattcattaaataaatagaaacttttaaatgccacatgaccagaaacaacaaaaacaatggtatgcaataataaaagtgaaagcccatcatttttacagggtctgccatttaaaaaaacctttcatttatattatctacttgtgattctaattacagaggtctgcagaggttaaatacttgatcaagaacactgagtttatacaaggcaaagctggaactcagagccaccttgtcatagtaacaaatgacaatttaaaacatctagctgggctcacgcctgtaatcccagcactttgggaggctgaggcaggtggaccacttgaggtcgggagttcaagagcagcctggccaacatggtgaaaccccatctctactaaaaatacaaaaattggctggacatggtggcgcatgtctgtaatcccagctatttggagactgaggcaggagaatcgcttcaacccgggaggcggaggttgcagtgagccgagatcacaccactgcactccagcctgggcaacagagtgaaactctgtctcaaaataaaaataaaaataaaaataaatgtttatttacctaaggaatagtagatcgttggggagggggaataagccaaagttatcaatgttaccatcactgatatatgccacaaatttgtccaatttttatccctagttttgaagcaacagggaagggaatgttgctaggaaaaaagtatattaagaacaggcttaattctttttgtttacagtaactggggaaggtcaagttgtttgaattcaccaggatgaaatcaatagttttagcctaatcaggaatctggataacagttctacttctgcttattacataagacaattcatgggcaaatcccttaaatcagacccgtggtcttcttgtccctgaaaggagggggactggagcaacacatcccttccagtccccaaattataagattcagggatttttttaaaaaaagagttatctaaactggcagttaatagttaaaaagatttaaaaaaatgattactattattggtacctatttttctataggaaataggagtgaaatgactggtcgtctttaaatctatcctgtaatttcactctctagtactgtgctctcagattctaagattttatcaccagataagtaactctggatcatattttgtaagagtacaatttagtatatgtcagagaagcattgacagtatgaaaaaatttgagaaaaatttcttctggtgatcttattcctattttagctacccaaagcaatctattaaactttcaatgcactggatttttaaaaaattatcttaaataaaagtcttcatgccgatttatgtacatatattttagtactcttgaatatttctcatgctaactcttttttttgagatggagtcttgctctgtcacccaggctggagtgcagtaacgtgatctcggctcactgcaacctctgcctcccaggttcaagcaattctcatgcgtcagcctcccgagtagctaggattacaggcatgcgccatgatgtccagctaagttttttgtatttttagtagagacagggtttcaccatgttggccaggctggtcttaaactcctgacctcaactgatccacccacctcggcctcccaaagtgctgggattacaggcctaagccactatgctgggccctcatgctaactcttgattagaaaacagtcacaaataaatacaacttatgttaagtaatcagagtaagaaagtaattaccatattgaaagattaataaatgtttttacaagatttttcaccaaatcactttctttccattatatgttaaaaaatttcatctgcttttgatctgtccattttcctccaaagcttctcaaatttttttagcatcctaagcttcagaaatcagggtggcagacattgctattaatatttgcctatccattcattcctgtgtttgcgccactgcactccagcctgggcaacagagaccctgtctcaacaaacaaacaaacaaacaaacaacccaaattgttacttataataacttgaaatctcttcaaatgttttgcatttaagttgatgttaaaatagcagagttaattgtgttttgccacgcagacaagggagataaaagacaacggagcctgctttctctctatcttctttccttccctttattctttttgagaggttaaaaatatacagaaaagtacatactcttgactacatttggagtggcaatggtcctcacttaaaaaccttacctcctcatgatccccttcagctagatgtgatcatgtgacacagtctggccaatgaaatgtaagcactagtctaccaggtggggtttctgagaaatttactgagttcctgatataagggaacagattcagttggtgtatacctttgatattttgggcttacccatgttccctgactggaatatggcccagctgcctggaggcacagtagagacttaaggatcctaaagagggctcccaaccctctaaacctcctaaagagggttgggggccctcctaaagaggtttaaccctctttaagcctggtagagcaaaaagaattttgagcccctgctgacttgagggctgcatcagctctgatgtgtccacctctagacttcttgttatctgagataaacactgcactctttcaagtcactgtttgttagagtcttgttgtaagtcttgttagagtcttgttatatgcagccaaatacattctgagaagttatagtcaataaaaattgtgacaaaaataatagacatctcatgttcataattctgcactctggttttattcacctaacattatctctcagagacagtcctgtatcatttagaagtagaggatctcctttttctatttaacatcgctactgaggtccactgtatgaaagtaccatacaacttttggggctaaagggtttgtgatcaatattattttttgtctaaagactttttaataatcagaccatgtgtaacttctttaactttcccagagttagaactctttcttctgtgcatgaaagcctttgaatatggctcagtcttgtattgacttgactgtaattatttctttagctatctctctccctgccacccccttccctcacgacactgtaaattatactatcctacttccctaggctgcctataaatatctgttaaatgaacaactctttacttagcaatttatttatttatttatttatttttttgagacagagtcttgctccgtcacccaggctggagtgcagtggtgtgacctcagctcactgaaacctccaccccctgggttcaagcaatttttctgcctcagcctccctagtatttgggattacaggcatgtgccacaatacctggctaatttttgtatttttagtagagatggggtttcgccatgttggccaggctggtctcgaaccgctgacctcaggtgatccacccgccttggcctcctaaagtgctgggattagaggtgtgagccactgcacccagccaccattaatgtataaaggctatagggcatcactatcattcttagtttcaaaagggaaggaatgacataaactaaaaagtagggtttatagaatcagagttggaagtgaccccagaggtcagttagtctctatgtatccccatacagggattagtggtaactacttcacaggagccatgtcagctgatgaacagtttttatttttagaaacagggtctcactctgtagcccaggctggagtacagtggcgtgaccatggctcactgtaacctcaaattcctgggctcaagtgatcctcctgtctcagcctcctgagtggctaggactacaggcacataccaccatacctggctgctttttttttttaattattttttggggccgggctccgtggttcatgcctgtaatcccagcactttgggaggccgaggcgggtggatcacgaagtcaggagattgaggccatcctggctaacagggtgaaaccccgactctactaaaaaaaaatacaaaacatttaccaggcagggtggcaggtgcctgtagtcccagctactcaggaggctgaggcaggagaatggcgtgaacctgggaggcggagcttgcagtgagctgagttcgtgccattgcacttctgcctgggcaacagaacaagactccgtctcaaaaaaaaaaaaaaaaagaagaattttttttttttgtagagacaggggtctccctatgttgcccaggctggtctcgaacttctaagctgaagcaatccttccatctcagcctcccaaagtgctagggaaacagctgtgagccaccgtacccagactgataaacagtttggctgggtgtggtggctcacacttgtaatcccaacactttaggaggccaaggcggggaggattgcttcgcccaggagttcaagaccagcctgggcaacatagggagacctcatctcaatgaaaaatgaaaagaaaaaaattagccaggtatggtggtgtgtgcctgtgattctaagctacttgggaggctgaggcaggagggttgcttgagcccaggaagttgaggctacggtgggctgtgtttgcaacaccgcactccagcctgggcgacagagtgagaccctgtctcttaaaaagaaaaaagaaaaaaagaaaaaaacccaccagaatcgttccttataataacctgaaatctcttcaaatgttctgcatttaagttgatgttaaaataggagaagaattgtctgggcgcggtggctcacgcctgtaattccagtactttgggaggctgaggtgggcagatcactggaggttgggagttcgacaccagcctgaccaacttggagaaaccctgtctctactaaaaatacaaaattagctgggcgtggtgttgcacatctgtgattccagctacttgggaggctgaggcagaagaatcacttgaacccaggaggcagaggttgtggtgagctgagatcgcgccatggcactccagcctgggcaacaagagtgaaactccatctcaaaaaataaataaataaataaataaaaataggacgggtgtggtggctcacgcctgtaatcccagcactttgggaggccaaggcaggcgaatcacctgaggtcaggagtttgagaccagcctgaccaacagggagaaactccatctctactaaaaatacaaaaaaattagccaggcatggtggctcatgcctctgatctcagttactgaggcaggagaatagcttcaatccaggaggtggaggttgccatgagcctagatggtgccattgcactccagcctgggcaacaagagcaaaactctgtttcaaaaataataataataaaataaaaataaataaataaataaaaataaaataggagaagaattgtgtttcgctatacggacaagggagataaaaagacaatggagccttctttctctctcactagcttccttacctctcttctttttgagaggttaaaaaaatacagaaaagtacagagaataatatttacataatcttccacttagaaataataaatatttacactttgtcatttttaacagcttttaaatatgcttttttaaaattttgggaattttcaaacatataaaagtagaaaatattgcatcaagaacatctgtggacccaacatccagctttaaaatttgttaactggctgggcgcggtggctcacacctgtaatcccagcacttcgggaggccaacacaggcggatcacctgaagtcaggagttcgagaccagcctggcaaacatggtgaaaccccgtctctactaaaaatacaaaaattagcctggcgtggtggcaggcgcctgtaatcccagctactcaggaggctgaggcaggagaatcacttgaacccgggaggaggaggttacagtgagccgagatggcgccatcacactccagcctggaggacaagagaaagacttcgtctccaaaaaaaaaaaaaaagagttgttaaccatagttaaccttgttttagctacacccttcattcctctttcagactttgaagtaaatgccagatatgtcacttcatctgaatattcttcgaaaacactattttaaaaagtgcctaatagtgattatggcaactacttactaaattactctgagacaattactgtatgctgaacactatgtaaaaatatttttgcaaaaataactcaattaacaggttaataaacaaaataatatacaactcacaacagctctctgaggtaagctttattatctcttccgtacagaaggcagctaggctgacaggctaagtaacttgcccaagttcacacagctagttaactgcaaagctggattcaagcccaggactctggttctaaagcctgggctctttgcatatcaatagaaaactaataaatatcccaaacacaacatgtgcaaattcagggtctttctaaaaatattaaaatgataggcaagagtcatccatttaaagtcattttacttgaatcctaaaatttgtttttaaaattgaaaaactgatttttatgttcatatgggaagaataaatttgaaaattacaaaaaaacaaaactttggaaaaaaaataagagggctgccgttctagattttaaatcttactataaagttactgcagttttaaaaagtatagtatggctgggcgtggaggctcacatctgtaatctcagaactttgggaggctgaggcaggaggattgcttcagcccaggagtttgcgacaagcctggggaacataataagaccccattttgaagaagaggaagaagaagaagaaggaaaaaaaagtatgatatcacaagaatagactaatagattagtgaaatggaatccagagagagattcaaatgcaaatgaataattatttacgataaaaataacaattcaaatcattagggaaaagatggattattcttacaaatgatattggggcaattggctatcatttatgagaaaaaaatgttagatccctatcttacaccatagataaaaacatatttaaatggattaaccatctaactgtgaaaagcaacactataaatttaggaaaacatccttatggacatggggtgagatagttttgcaaaacagaataggaactcaggaagctacaaagaaaacaaaggatagggggctgggcgcactggctcatgcctgtaatcccagtactttgggaggccaaggcgagtggatcacctgaggtcaggaattcgagactaccctgaccaacatggcaaaaccccgtccctactaaaaatacgaaaattagctgggcttggtggcgggtgcctgtaatcccagctactcaggaggctgaggtgggaaaattgcttgaacccaggaggcagaggttgcagtgagccaagatctaggctggagcctagtcaaggagcaaaacttcgtcgcaaaataaaaaaaaaaaaaaggaaagaaaagaaaacaaaggataaatttgaggagttaaaataaacaaaaaagtttaatactaaaatataccataggctgggcgcagtggctaacgcctgtaatcccagcactttgggaggctgaggtgggtggatcacttgaggtcaggagtttgagaccagcctggccaacatggtgaaaccccacctctactaaaaaaatacagaaatttgctgattgtggtggcgggtgcctgtaatcccagctactcgggaggctgaggctggagaattgcttgaacctgagaggcagaggttgcagtgagctgagattgcaccactgcactccagcctggttgacagagtgagactccatctcaaaaaaataataaaataataaaataaaatataccataaaaataatgaggcaaatacagacttgaagtacttgcaataaatacaataaacaaaagatttatatttaaaatatatgtgaagcttacccaaataagtaagttaaagaaacaatagcaacatgggaaaaggtacaaagaggtaattccagaagaaatacaagtggccaaaaagtatgtaaaatgatgctcaacctcactaataatttagaaaagagtggccaggtgcggtggctcacacctgtaatcccagcactttgagaggccaaggtggatcatgaggtcaaaagatcgagaccatcctggccaacatggtgaaaccccggttctactaaaaatagaaaaaattagctgagcatggtggcacgcgcctgtagtcccagctacccgggaggctgaggcaggaggatggcttgaacccgggaggtggaggttgcagtgagccgagattgtgccactgcactccagcctggtgacagagcaagactccgtctcaaaaaacaaaacaaaacaaaaaaaaggaaagtattacaataacaatgaaataacatttttagttcattgactttgcaaaaatgaaaaagatcaagaagatacagttttggtgaaggtagaaattggggtctcacactgatgccccaagagccaaataaagcccacagacatacaatttggcaaatagcatttccaaaactaaattgaattggaaagcctttggagccaagctcttcagcttgccacagtctccaccacttcctttacctttcacattcgcttgaacagcctgacccttgaaggtagccactcacagggaaatttccctgaatatactactgtattggaccttaagttggtacaatcacttagaaaagtatggtatctaaaaaaattaaaaatatgcatacctcttgacctatgatactctactgaaacagcataattttatatacccacataaacatttttttaattaaaaattttcattttattttttttgagatggagtcttactctatcacccaggctggagtgcagtggtgcaatctcggctcactgcaacctttgcttcctgggttcaagcaattctcctgcctcagcctcccaagtagctgggattacaggcatacaccaccacacctggctaatttttgtatttttagtagagacaggttttcaccatgttgaccagactggtcttgaactcctgacctcaggtgatccaccgaatcagcctcccaaagtgctgggatcacaggcgtgagccactgtgcctggcccaaatttttattgtattttaaaattagagatgggtgaggtggcgtgtgcctatagtcccagctattagggagcctgaggtgggaggatagcttgaacccaggagttcaaggttgcagggagctagcattgcactactgcattccagcctgagcgacagagtgagatcctgtcctctaaagaacaaaaaaacagtgaaataagaataaaaattagagatggggttttcctatgtcagcaggctggtctccaactcctggcctgaagcaatcctcccacctcggtttcccaaagtgctgggattacaggcatgagccacaacatgtccgtccaacatgtttgtttttaatagtgtacattacatagtttggtaacaacaaataattagaaacaagctaaatgtccattaatgtagtacaatactaagtagaaagtaaaaagaatgtggtacggccaaatctacgccttcaaaagttggtaagtgcaaaaaaaatatgagggctggaatatttgtctgttttttccattattctatctccattgtgtagttcagtgcctggtaggccctcaagtctttgttatatgaatgaatgaatgaggagcacaagttgattttcggagaaaaaggaaaaacaatgagaaggaagaaaagaggacaggcagggagcaggaaatgcagatgctgagattatgaactttttaatagacttttttatttttggacgtttaaacagatttagatttggagggaagtaggggatagtcattggacagtagcagacaagcccatctaatacagacaggagcacagatgagattggacttgtgactgaagagggccttgaaaagagcaagcaacgagtttaggtttttctagagcagtatggggtcattaaggaggggctggacaatatgaagatgccgggacgaaattgttttttttttttttttttttttttgagacagagtcttgctttgtcgcccaggctggagtgcagtggtacgatctcggctcactgcaacctccgcctaccggattcaagcgattctctgcctcagcctcccgagtagctgggattacacgtgtccgccaccaagcccagctaattttttgtatttttagtagagacggggtttcaccatgttagccaggctggtctcgaactgctcacctcacctctcaggtgatccgcccacctcggcctcccaaagtgctgggattacaggcgtgagtcaccgcgcctggccgaaattgatattttaagaaatggaggccgggcgtggtggctcacacctgtaataccagcattttgggaggccaagatgggcgtatcacctgaggtcagcagttcgagaccagtctggccaacatggtgaaaccccatctctactaaaaatacaaaaattagaagggcatggtagcaggcacctgcaatcccagctactcaggaggctgaggcaggagaattgcttgaacccgggaggcagaggttgtagtgagccgatatcgtgccactgcactccagcctgggtaacagagcgagactctgtctcaaaaaaaaaaaaaagaaagaaagaaaaagaaatggaggccaggtgcagtggctcatgcctatcatgcctataatccaagcactgtgggaggacaaggtgggtggattgctcgagcccaggaatctgagaccagcctgggcaacacggcgaaactatccctagaaaaaatataaaaattagctggacgtggtggtgtgcccttgtcctagctactcaggaggcttgaggtgggaggatcacttgagcctaggatgtcgaggctgcagtcagccaagatcatgccactgcactccagcctgggagacagaatgaaaccctgtctcaaaaacaaaaagaaatggaatatgccagtataatccaggatgtggagcatggggagagatgactatgactgtcaagaagatcaggctaccacagcataatttcagagaactctagttgtaaagagcccatgaggccaagtagtgcaagctcattagggaaagtcactcaacttctcctgggctcaagcaatcctcccgcctcagcctcctgagtagctgggactataggtgcacaccactaagcctggctaatttttttttaaaaaatgttttttgtagagacagggtttcactttgttgcccagtccaggctcaaactcctggccttaagcctcggcccgtgattacaggtgtgaggcaccatgcctggtcctattttagtatttccagtgacaaggagctgatgacttaatgaggacacctattctgttaaaacagttttgtaagaagtttatttctttacaccacgatttgccaaactgtaactatcacaaagttgtttctacttttctaataatttaggagtgaaatgattagaatgtgaactctaaggtgacaacagaggtacacggggagtgatacaaaataatctcatggaagaactgcagtattgctgtgtgactaaatatggaggataaatgaaagatactttttagatgtgaggctggagtggtaaaacggtagcagaaacgaggcaagcaggaaaatgaaaccaccaggtccgttgctcttctgctcaaaaccctccagtggtccctatctcacttactttggtaaaagccagtccctataatggactccaagtctaatacaatctgccacaatttctccaccccccgcctctctgacttcattccctttgcttttccccctcattcactctcttctgtgacactagcttctttgttattccttaaacatgccaagcctattcttgcctcagggcctttgccctttcctctatctggactgcactcggcttatgtatctacaaggcttagccattcaccctcttgaggtctctgcaaaagtgcacctctctctacataaggccttccctgggcaagccatttacaatagcaaccctgtcatcctcatcagcattctcgatccctacttcctgctttttttcccctccatagctcttattgccatgtgacatactagcttttttccccccacttgtttgtgttttatctctccccaaagtcccaaagaacagggcaaataatcagggtgggagcagacggagaaacagagaaaagcaaaaaaatttctaaaacatgcttcaataatatcaagctcaaaccgttaaaaaaaaaaaaagcatgtgagcgctaatgaaaaggaaaagcatacatacttttgtaaacctgtgccgggtaaaagaatctttcgtgatgataacctttaactaattataagtgccaaatattaattttttataagtagacttaaagtcctaagagtcattcaatttaagttgtgataattagataaacataaggattttcctattttgtcatttattcatgttgataacttaaattaaaatggaactttgtatttggggttggccatgagtatatcattcaaaattcatcttatttcattcttaaattttgaaatgagaattctgattttattttataatttttttttttttttttgagacagggtctcactctatcacccaggctggagtacagtagtgttattgtagttcaatatgacctcaaactcctgggctcaaggaagccttccacttcaacctcctcagtagctgggattacaggtgcgcgccaccatacccagctaatttttagttagttttttttttttttttaagtagagacgggggggtctcactatgttgcccaggctggtcttgaactcctagcctcaagtgatcctcccaccttggccttccagagtgctggaattacaggtatgagtcaccatgcacagcctagaattctgtttttaaaaatagggtaggaaaatgaaaaatctcaaccatgagaggccaagtgccagctgggcacggtggctcatgcctgtaatcccaacactttgggaggccaaggtgggaggactgtttgagcccaggagttttgagaccagcctgggcaacatagagagacctcatttctatttaaaaaagaaaagaaaaaagaaaaatgccaaggctgtaggccgtaataaagatgacctccaagtagtgatcaagttacaggttcaagggttggaaaaaatgaccaggccttacttccagctctgagcacacacactaagcaattgctgagggtactgagagctctgtgtctcttttagaaaagctcacccaccattctaagttatagtatacagaaaagaagcagaaaataaaaagtctctgcagctggtctcagttcaaagagattagatacttcagtctatgttagaatcttgcatgccatgaaaacacaaggtccaaaagtgaagaaaaacaaatataaagacaaaaatcttttaagtagtacttcaattaaaaaaaaaaaaaacctttaaaacaaaaattctcccatattcagtgctgtaatttagaactactggtacttttgcagaaatataattttaaaataatcacagcttaacacaaagacttgcattcatttcctcccctcttgatttatttccaaaaaagaaaactcagtattgatgtgttctgtaattaactccctccatacctgccagccaatctacaaagaagtaagatgcctttggtggtggtagtcatacttgaaagagcagagggatgttgggactcagcaaggagtcaccatatttatcactagaaattagccaaccaaaaagaaatttgtattgcatggtctctttatgcatgaacataataaagctctgcttagtgatcaatgaacacacctatgagagtactttaataaagaataaccaagccaggtgacttactatatttaagaacatttttctaaatgctgttttgaataactgagacatacacttgatactgtcaacacataattatcctgcaggtcaaccagatgcttatgaggaggaggaggggcagctaactaataataatctctggtttctagaaacagttatgtggggctcttatctgccagaggagcagagagaaagcctagctaggcatccttatctaggtttctaaaagtactttggggtttgcatgtcacaaaaggggttaaaaatacttgagactaccaaaaaagcctaacaagacatctgggtgcggcggctgtcactgtcagggcagcccttggagggaatacccgtatcaattcggtttatcagatggacagctgatcaacattaaacagacttgctctgggcagactgagctgagcttcctgacatgaattccaatgaaagccctccgtactctaccactgagctctgccatttttcactgttgcagctccctggacatatgggaatccctagtgatgagcacataaagctgcctctaactcaagtgacggctcatttcccctggctgaaggcagacattaatatcctgaggagatcagacctgcctctctgacccccatctaccgaagcaaaacgactgtcctatttctttctttaataagcttttaatgaagaaaacccagaccccctctctgactgcagcacagttttacatgaaaaggttatacaaatacatcacattctgtgtcaaagttttccaaaatatctgtccccctccccactggagagcagattctatcacttgccctcccatagtgctcatgctttctgccgcggtacgggagttcagttctctgctctgataattacgaattgtatccatggtctggcaggtggaggattaaagaactgattacaaagagcacactggagtttccattttcattacaaacccctttcttcaagggtttgtcatttagctatgaaaactgcttcaggcacaactggactgggagaaatgacagtccactgacaacccagagagtaaactagaaaatgctgctgagcaaaatcagcatatgagaaagctaaaaatatttggtgaactggagtgggcatacatactttgattttagaaggggtagaagaaaagatgtgtgatagcagatgaagaagacaagcaggcttttacctatgaatactggagactggatcaaaataagggggatctcaatcattattaaagtttagtgacaggaccaacgccaactgccaggcattgagttctgaattgcttcacaagaggctgaggtttgggttttctctcctttagagagcaagcaggggttaggaaaaatgtgaaggctgcatgctaaatggggcacagtaagcactgtaggagggaaatgtcattctgcaaagacctctccagctaaataacaagaggcagtgatggaccaaagagggaaccttggcaggcttcacttaggccatcaaatgtgtctgaggctgggaaatgtgaaggtaaggtgggaataaaggggcaaagatctgtttccaatgaaaaagagtgtcagggcatagtctatacagtgagaagcttaaaattagattgcatgctctgctacctaatcaacctaggtatctagagacacaagaacaaatcctaaatgtccccccaaatacttcaccaagtattttcatgtataaaagttgagaaattcctcagaattttttttttaattaaaaaaaattttttttagagacagggtctttctatattgtccaggctggtcttaaactgctggcctcaagtgatcctcctgcctcagcctcgtgagtagctaggactgcaggctcatggcactctgtactaggcttctcctgcatgtttaaaccatagacaataggtgccattggcaggtactaagtgtacagcttaatgcgtaactcataacatactatgtcccagatattctgatttttaaaatatagtatctcatttaatcttcaccaagtatagttattagccctattttacagataagaaaatggaaattcagatatattaactgatttgcccagggccttatgactaataagcaatggggctagatttggactaaaatacttttgctgaggtaaaatataattcatctgctaacaaacctcattgcctccctaaagaaacaatttttttttgtataatggaataattgtgggtagcatttacagtctgtcactagacacaggggttctgttctttttttcttttttttgagatggagtctcgcttggtcacccaggctggagtgaagtggcgtgatcttggctcactgcaacctctgccccactggggttcaagcgattctcctgccccagcctcctgagtagctgggattacaggcgcacgccaccaagcccagctaatttttttgtatttttagtagagatggggttttgccatgttggccaggctggtcttgaactcctgaccttaggtgatccacctgcctcagcctcccaaagtgctgggattacaggcgtgagccaccgcgcccggccagttctgttcttaacatctgttatactgtggactcctttggcaatctggtgaaacctaaggattctactaagaaaaatggttttaaacacataacataaataagattatgaaggatgccaattatgttgaaaataaaaatgtaatcatttttccatccaagttcattgatcgctgaattcaacccacatattcccttgtgggtatctgtgaaaaccaggtaagtactcttgtgaggaaataggaggggatgtggggatgaagtgtcccccgcgttggctaagtgctttatatagactgtttcatgtaatacctccaacaacctgataaagagagaatcattaagattttatatggagataacttagatttagagaggtcaagttatttgcctaatgtcactccaagagtgaccagcacagccagtgtgacctgtgaatccatgctccttccattttaccaaattgccaggtaaatgttgggatgggaagaacatgggggtggggagaaggaaaaagtttgattggcatcacgctacagcaataaatggtcttttattccttgaccttatgaaaagccagaagggagtgaccctagaataattttttttagagaaaaaaaatgacaacaggtacataacagattatatatctttttggtaaatagtctgatgttcaataccaccaccaccatcatcctgtgggaagattatgcatctccatgctcttaaactcaagtaagggtatgtgaattgcttttgtcaatgagaagtgagttaaaaatgtcatttctaagcaaagctgggtcgtggttcacctggtctcttttctgacatgagaccagtaatgttccaaatggagggctgctccatcagccttagtctaggagtaaggatgatatggatatgacacctgaataacaagtggacctttattttgtgagtcattgagacttcagggccatttgcactgcagcataacctagcctaccctaacacatggtgagaatagtcctgagcctttcctttgtctagtatgaaagatcatgtgtactacgtgtatgacagagctggcattacgtactaagggagtaaggcatttatatgatgcctttgaagcatgagtatgaaagatgtcaaaaatgaaatatttatttttctcacagccttatatctctttatttttgtatataatgattgaaaacactggactcaatggggcatggtggctcacgcccgtaatcccagcactttgggaggctgaggtgggtggatcacctgaggtcaggagtttgagaccagcctggccaatatagtgaaacctcgtctctactaaaaatataaaaaattagctgggcgtggtggcaggagcctgtaatcccagctactcaggaggctgaggcaggagaatcacttgaatccaggaggcggaggttgcagtgagccaagattgtgccattgcactccagcctgggcaacaagagtaaaactccatctcaaaaaaataaataaaataaaacaaaataaaaaaataaaacactgaactcaattcatcctttacccaaaatagagtactgcatacttagtaaacattccataaatactttttgcattgttattgaagaatgcctggtttaaaaaaaggttattcaacactatgtttatacctcatcacaaatttgaaactagagaaaaatacgaaaatgaaacatttaatggtgttgtaagagaagtggaaatcccaagaaaaattattttcccctcagtgcttgactgccaccatccacaaagcactgcatagagagtaaacaattacaatggtctagatctgggaagggaattaacagaacatcagatgggcactgcagcaggggcctctcacatgggcatagacaaaggaatacaccccatcctaaccagtggatgacatgggggtagtgacaattaaaagaccagtgtttcccagaaaggcttcccaaatctcagtcagtctcagatttaatgtttatgcctcagtaaatatgaattgctttttcataatcctctattaaaagtgctcttagggtacatatacaatatccctcctttcctagaaaaaatactcccagaagtatctggaaaacatgtaaacagtatttttggaggtgggagtgaatttttttttttttttgagacggagtcttgctcctgccacccaggctggagtgcagtggtgcgatctcggctccctgcaacctccgcctcccaagttcacaccattctcctgcctcagcctcccgagtagctggggttacaggcgtccgtcaccatgcccggctaatttttgtattttagtagagactgggtttcaccatgttggccaggctggtctcgaactcctggcctcatgatccacccgcctcggcctcccaaagtgttgggattacaggcatgagcccctgtgcctggctgggaatgaatttaaggctcatgaaaggatgaaggtgagatgaagattatattggaaacaaaattttatttatttatttatttatttgacagagtctcactctgttgcccaggctggagtgcaatggcgcaatctccgctcactgcaacctccacctcccaggttctagcaactcttgtacctcggacacccgagtagctgggattataggcgtgtgccaccactcccagctaatttttgtatttttagtagagacagggtttcgccatgttggccaggctggtctcgaactcctggcctcaagtgatcctctgccttggcctcccaaagtcctgagattacaggtgtgagccactgccccagccagaaacaaaattttaaaaaacaaatcataaataaaatcagtatgatgtgaaaaagatatgagaaggaaaactgggatagtgcattcagttattattccaaagcacactacaaattatatgaatcccctattgagaagaagtagcagaaagtgagagaaaggtaaggaatgaaaagaaacacacaaacacatatagttggccattggtattggtgggttctacattcctggattcaaccaaccactgacagaaaatacttgtactgaacacgagcagacttttttcctggtcattattccctaaataatctagtataacaactatttacatagcatctacattttactaggtattataagtaatctgaagatgatatgaagcatacaagaggatgcacagtggttatatgcaaatataaccattttatatcagagactataccattttatatcagggacttgagcatccaaggattttggtatccaagtgagatcctgggaccaagatccatgaatattgagggcaactgtatatatacctatatacatagtgtagctttatatacatacatgtgtgcatagatatgcatgtgtatgtatgcatatatgtgtgtgtatatataggcatatgtgtttgtacagatgcatacatacatacatagttggctaggttttagtaaagagtttgaaatccataagacctaaatgttctcatcctaagaggtggcctgatctcccatgggatctgaattgcagtaaaaagaaatgagcactcttccatagcaaatgaagttaacaagaaacatataccaaataggaccaggcatggtggctcacatctgtaatcctagcactttgggaggctgaggcaggcgaatcgcctgagctcaggagtttgagaccagcctgggcaacatagcaaaaccccatttctactaaaaatacaaaaattagctggtgtgatggcacaggccggtagtcccagctattaatacttatggggctgaggtgggaggatcgcctgagcctgggaggttgaagctgcagtgagctgagatcgtatcactacactccagtctgggtgacaaagtgagaccctgtctcaaaaaaaaaaaaaaaaaaaaaaagaaacaaacatataccaaataaagaattaaaagaaaaaaaaccctctcagaacattttttgagatcccaaattcaaattccagttgtgtctttttttaaatacactcacagatgagcattatctcattcaaagcagagagccacagtggtctttgtatccaacccaggcatctcactatctttattttgctagattagcaggatactaaaagttaaaaaatgtttttaaaaatacactggtttccaaaggaacccgaaaatccaggagacaacgctagctattcctgtgaacctctagaggatctgcacctgctcttcaagcaacaaccatgaggaaagtaactagaattgtagatccccatggccctcccttgtcataatttttctctttactgttctcttaccccctttcacactcactgcacctcctccatgctgctgtactaccagtagctccccttaccaagagcttctatgaagaatgcggcttcccgaatatattaatgccccattgtataggagtttttctaaatgaaaccccactttcacccccacatccatatgccccgcaactgctataactctgccactctttgcatgcaagcaaatactcattattggacagggaaaataattactcccagttgtcctgggggcttggagccactgtctgttggaccttacttcacccataccagtatgtctgatgggggtggagttcaagatcaggcaagagaaaaacatgtaaaggaagtaatctcccaattgactcaggtacatagcacccctagcccctacaaaggactagacctctcaaaactacatgaaaccctccatacccatactcacctggtaagcctatttaataccaccctcactgggctccatgaagtctcggcccaaaaccctactaactgttggatgtgcctccccctgcacttcaggcctacatttcaatccctgtatctttaacctccttgttaagtttatctcttccagaatcgaagctgtaaaactacaaatcgttcttcaaatgaagccccagatgcagtccatgactaagatctactgtggacccctggaccagcctgctagttcatgctctgatgttgatgacattgaaggcacccctcctgaggaaatctcaactgcacgacccctactacgccccaattcagcaggaagtagttaagaggtcgtcggccaacctctccaacagcacttgggttttcctgttgagagggggactgagagacaggacaagctggatttcctaggccaactaagaattcctaagcctagctggggaaggagaccgcacccacctctaaacacggggcttgtaactcagctcacacccaacccatcaggtggtaaaaagggctcactaaaataccaattagactaaaaagaggaggtaaagaaatagtcagatcatctattgcctgagagcacagggggagggacaatgatcgggatataaacctaggcatttgagccggatgggtaaccccctttgggtcacttcccgttgtatgggagctctgttttcactctatcaaatcttgcaattgaaaaacaaaaaacaaaaaacactggtttgcagcgtatgtatacacacacacacgtgcataaacacatattcacacatatgtacacatacatacatgtatgtgttttacagcaatttgaggtgggcataggcatatcatttattcattaacccccccaacagaaaactactgacatttactattcacagcagggagtcctataaagactccctgagtcttttaatcatcttttaatcttcccgcaccactttcctatgaaagagaaatttgtagatggcacacttgtttcatttgaaataagcactcatggattttcatccgagtgaacacacattaagtccacattacaattaagtgaagtgatgaaatttgaaagaatgtatgaagatagctttttatagtatataaattgtgattcgcggactttttcattactttgtgtgtatatattactcctttccttgaaaagcagtggcagccttttaaacatttctatagtttttgtggacctaaacaaaaacacacactaaagaagaattgtgaaattaagaattgcccggtgtgtgcagtgtgattttagagtaataaagtttgttttctggtgaataaactatgtatttcccattcaaagtaacttgcttgaaagttatattaatatatggatacctaaagtgctaaaaacactttaccattttttgaaataatttacagttcatttgcaaaaacaaaacaagcattactttcagacacctactgtagctgtcatttatataccttggagaacacatatgttggtgggtatcttatcacagactgtaatattttttcagtaaaagtatgttgacatttttattttatattgttgctatttataattagtttcattaaaaattccaaacacttgaaaaggtaaaatgaaaatttaaaaaaatagtccaggctgggtttggtggctcacacctgtaagcccagcactttttgaggctgaggcaggcagatcacgaggtcaagagtttgagaccagcttgaccaacatggtgaaacctcatctctactaaaattacaaaaattagccaggcatggtctgggctgaagcactgaactcgggaggtggaggttgcagtgagccgagatcacgccactgcactccagcctgggtgacagtgagactctatctcaaaaaaaaaaaaaaaaaaaaaaaaagttcaagtaggtaatgactctatatgggcttaaggtttattttttaggtaataaaaaagttctaaaattagatagtaatgatagttgcacgactctgtaaatatattaaaaattattgacttgtattcttaaaaatgggtgatatgtaaatgatttctcaataaaactgttctttagaaaagttagccttcaatgagactattcacaatttttataggcagatctgaagtctgaaaataatttatcatgcacggtagtaagagtattttgtaggatccgattgtttaaaaagatatttggaaatgccatctcattttaaactttccctctttttttttttttgagacagagtcttacactgttacccaggctggagtggtacagtagtgtgatcatagcctactgcagcctcaaattcctgggctcaaaggatcctcccacctcagcctcctgaatagctgggaccacgggtgcatgccatcatgcctggctaattttttttatagagatgaggtctcactatgttgccgaggctggtttcaaactcctggtgtcaaaccatcctcctgcctcggcctttctaaacgctgagattacaggcataagccacagtgcctgaattaaatctttcctctatttaacattcagattgtatgtctttccctctcttggataatatttcctataaagacttagggagtctttaaaaaacatcacaattatttaatggcctactttaaaaaatatcatataagtcatatgagagtatgctcttcctgtaaaaaaattaaaataatataaaagtatatcaatatgatagccgtcaactgcatgtagctactaagcccttaaaacattgtagctggtctgaattcagatgtgctgtaaaaacttactaccaaaaaaaaaaaaagaatttaaaatatctcaataataagtgctttacactgattacatgttaaaatgatattttagtttaaaaatattacaatcaatttcatttgtttccttttacatttttagtgtggctactagcagattaaaattatatttctgtctaagtccattttctgttactaaattgagtatcacagactgagtaatttataaagaatagttcatggttctggatgctgggaaatccaaggttgaggggttggcatatggtgaggacctttgtgctgtgtcattccatcgcagaagagcaagggagtgagtactaaagagggaaagcacaatgggcttggctccctttacaacatcccactccctcaataatgacaataaaacattcatgagagctccatgattcaatcacctctcatcagcccatctcctaacactgctacactggggaccaagtttcagcatgagttttggaggggacaaacgtgtaatcatagcaatttctttggacagagatacagtgtctcctctgggtccccactaggttcatcatccttccactctacttccttccccagaagttatctcttttatagcttagcatattttctttcagatttttgctatatgtttttaacatatgtttataaacatatagcaaatgctatgcatttacaaccatggaacaaatgctatgcatttttccataaaaatgtgttcatactatacatatggtactacaacttgctttattcacttagtttgaagacttttctatgtcacaaaatatggaaccacctaattctttttaatgatggttatttatttatagtatggatgtaccacaatattctccagaccccactaaaaactatttaggtcatgtcctattctctattattgtaaacactgctgcaccgaacatcttcatacatatatccatgtgcatatgtagggtatttctgtaggacatatctgtacaagtgaaattacaggatcaaagagtatgacatttaaaactgtgttagataactcctaaatgagttattttactttcaaagcaaaaagagaaaccatttgttttttgaccatctataacttctccataagtctctgaaataacaaggacataaacttcatgtccaggattcagaaaagaaaaacaattctaacttatgccctgacatcagcccagacttagccattgactattatggtgggcaccttcttgagggaccctgataatgattcccttttttcttgaaatgcttcctctcccttccccactgagattatacagtgggtagtagctgccatgtctgttctatgtgaccctcagtctccccaaccctggttgagtgacccagagctgagcaacaggcccaatcaaaggcccttagcttctttctccagggaatctgaaattcagggttatctgggagttgccagaggcaatgctccagagctacatttacaaacttcagttatttacttatcactttttgtcatttctgcatattccgcatgtactcttatatacgtaacgcttttctttagattttacctttaagtcctttcttaggatttttatctatgtatagagacaccacatagcatagaacttaaaagagcagattctagagccaggttgcctagattcacatcccagctattccacttaatagctgcgtgagctggatcaatgtgctcagctactctcagtgcccagtcgtttcatctgtaaaatggtggtaacaatagcacatgtgtcaaagtgtcatgggggttaaattactgtatatctagtccttagaacaataacttcaatagtaagtgcttactaaatattacctattactgattttaaaccaactcatctttccatttaaataaatctttagagaaaagttgacataccaactatctggtaagtatcgctcaaaagtgagtcacccacaaagcagcaatacctgaacctgtggtgacagggagtcatccattatacgaccacaggcactcctgtggggaaatcctgggcttggcacagaccacagagtcctctggacttctggatgctcctctcggtggtgggcaatactttcctgctcctccagtcccctctttatcccccagccctgaccagtcattgaaatccctttcataaacctgtgaaaaatcactgatttagactttcagcagagcagaaaggtctactgaataacttaaagtctcataggttttagatattagaactattatccaggtgccccaactcccagacaatgcttctacaatcaataaatttttttcatcagcaaatactttttttttcatattaacaccataccttcttgaaaagaaaattgctaaatatttcaagtaatgtcaatgtttggatcaaggacaactctagaggggtggcaagtgtggcttctgagtcccggtccccctccagcacttggtcattttccacttcaggtatctatggccctcttgctcttaccatgcctcctcacatcagaacctttctctgggaagaaccgtaagtcatttacgctttagggtgagtttaagttcatctaaatgaaaaattttgttataagaaagctctgattttgaatcctggcttcattttctatcacatgtagaatcttacaagttatttcatcctccaaagccttggtttcctcatttccaaatgggattaacaacagttatttcataggactgttgtaaggaggaaattccattcattatgcaagcaacagggattcatgtaatgtcaagtatctactgggcagcagacatggtctattcctaattacaccaattatttagaggtgtggacagataactaatgtcttcttttttttgcttttctggacaagtgggcctaattctccagctttatttattcattcaagaaaaggttaagtacctcttatgtggaaggtaccccagaacattgggaatacagagtagattaaaagttggttccagaaacttacagtctagtgcggaggggccttaacattatatttagaccttcctaagctagatccaaatttaagactcttttcagaatagaagaatattgaggatacccatcatctaacctggtacctcattttacagtcgtagaaatcaatgcctggaaattctaagtactttgttcaatgtcatacagatagttacccaaagaggacaagtaccccaaggccatatgggtgacagaagtacaatccttatctttgaatcttttttctaattcctgatgcccgcccacagaaactgactaaacaacttaagcataagttttctgtttgtaagtgatatggtttggctgtgtccccacccaaattcatcttgaattcccatgtgttgtgggagggacctggtgggaagtaactgaatcatgggggcaggtctttcccgtgctgttctcgtgatagtgaataagtctcatgagatctgatggttttgaaaaatgggagtctctctgcacaaactctctctttgcctgctgccatcaatgtaagatgtgacttgctcctccttgccttctgccatgattgtgaggcttccccagccacgtggaactgtaagtccaatcaaacctctttcctttgtaaattgcccagacttgggtatgtctttatcagcagcatgaaaacggactaatacagtaaattgctcaaaaaaattgtttaatgacaaaataaaaccaggtagtactgaataatcagatccttttatgatgctggaatgcatatgttccagaaattataatttattggtggtccttcagatatagtatgcagatgtattattatacaaggtttttaaaaaattgaactaatatctgacaagcaattttaaaagtcaattaacactgactataaggtacaaaacaaaggttatcagagatgaattttataatcaaattactaagtctgcctttttctgcacaataaacagaaacagtgacatctgaaaatgcccctttcacctcagaaaatgtgttgtttgcaaaagacgttaagtttgcaaatctttgtttcaggtctcaaatagttataagcataaggatctgattttcacagagacctctaagaccacattacttttggttgtaccttcttctctcccacacttatctttctcttttcctgtgtctgcccatgacttctcattctggcattctggatatatccacttttggaaaaggcagataatatggcttattgaagtaggcacacattctgtgaacatgcatttttaacaaataactaataaaatgtactttagaaggatgtccaaatgtgcacatggttctacaacctcatattttctgagcacctgtgatgtgcttggtgatgcctttacaccataaacacaatcacaatccttctcaaggaccttaaagcctggcatggataaaaataataataatcagaaacagagatatctgaaaatgtcccctgttcatctcagagaatacatgaactttttcacaaagggatagaactacgcattcaaatcagcgtacttgattcaaactacttgattgaaactacgcattcaaatcagagtacgcattcaaatcagggtacttgaagctcatctgatatacctccaactcacagatggggcacttctactttttaagccttttttttttttttaaacaggcagttgagagggtggctgtctatattattgtacttattctgaccaaactgtgcaatgtctttatacttttccaagtaacctgaccttttcccatttcttgtgggtattatattacctttcacgtctttatatatttccacatttaatcatcttggcatgttgctaccattattgtcttccctattcactggtctagttaattcctgtgtccacagtagggttcttttttaaaaaggaaaccagcttccttttaccactctgcattcttagactttcttccaatgaagttcaatcacttaaagagtaatataagccaacagtaattattttacaaatactgatgactcctctctttacaaatgagtgtatttgtaagtaagctttgaagatagtaaggctataaggaataagataaatgtgaaatatctgagtagaagccaccaatttccccctttagaggccttcctgatagttgataataccaaatggttcacaaaccaatttagaagtcaaagatgagcacaacgtactaagaaaggagaaagaataatttaacaggcactcaattcagattacatataagcgccattacaacaagctaaaacttgttcaccttaatctatctatatatttcatgactacatgaaatagcctactcctgagttaattaatgaaaaaacaaactttaaaaaactaaatattttgattatttgtaacttaaaagagaacaggtaaaaatggaaagaactgttaacctagattatctgattataattattatcaacaaaattatttatggaatatctactatgtgttagaccctagaaatataaagtataaaaagcatttttcttttatcgacgactatgtatcaaggtgtgagtatgtattctttctcttaaggtagtttaagacatggtctgtgtcctgagggctcatagtttagttggagatacaatacaatgaaatgaaaagatttaacaagaaaattatatagtacataagtgtaaactgaatgccacaatctataactgctgtaggggtacacagttatgatcactgaggatttggggggaggaatgggaagactccaaagaagaggtgacagcaaagttgtacttctcttagatgatgagcactttagattactgaatgcaaggacgttgctgctacacacccaccctactctccatgccatgcatggctgccaccataatgtgctggggggctccagtcagcttgctgctgctgctgctgatcccaacagggctcactgcccctgccagacgatgaacagagtcgacagctgccatggagtggtataaaaatggctgcagccagctgactgaaactggaatatgggtggagcacagatttagcacaaaggcttgggtgtctcctctagacagtgcttgagggaaaaagaaatgagaacaatacagaaaaggagaaaagtccaggaacatccttcatcttctagccacagccccaaatgatttggataaattaaggagaaaaaaataaatgaattgtgaaaaagtcattttcacagagacaaaagaaagttttacttaaattaggctaccaaagaaatatgagttaacagttggtcttagatatcactgaagaatatttactgccagttaattatcagaatgtcaagtcattatacttcctaatttcacctgcacattttcatctgagcacaatgccctgctgtggtctaaaacagaggcctacatattaatcagagtggccgtaacagagttaactcagtttgaagagagcagagaagctaacttagacctctgtcttcattctcattctgaagaaaagaatgaagtcaagatttctaacaagaggtgatacagacaacactctggcaagctgtttcaaaagataaaaatgtacccatttggcttctctttaagtaataatttagatggctcctaattgaactctccttccattgcacaggtcttggcctaccttaagccttctctatgaaaaagactgagccaggagtcctgagggcaaggagtgctggtgaagccctggtgcccacaatgcaggaacggaaggatgctggggtgtgccacaggtggcttatggtaggtggctgtcattgcgaatccttgataacacatgcaattccatttctctgtgtttctacaaagtccttacatgattattctaattatattattaatggcatatcttaagctgttacatggcactacccatagttggatatttatcatgttaaattatgaattacaaacatttcttcatataatattttacttaagtcctaaagcaagaaaatctagaataacgtactatatttgtctgcttggattgccataacaaaataccacaggctgggtggcttaaacagacatttattttctcacagatctggaggctagaagtccaagataaaagtgtcagcaaattcaggctgggtgtggtggttcacacctgtaatcccagcacttcaggaggctgaggcaagtggatcatgaggtcaggagatcgagaccatcctggctaacacggtgaaaccccatctctactgaaaatacaaaaaattagctgggtgtggtggcaggcgcctgtagtctcagctactcgggaggctgaggcaggagaatcacttgaacctgggaggcggagcttacagtgagcagagatcacgctactgcactccagcatgggcgacagagcaagactccatcccaaaaaaaaaaaaaaaaaaaaagagaaagaaatgcaattgtcttaagactccctctccctgagaatctaaaaaaacaaccaggaaagattcactgccaaaaaagagaaaagactaaaagtaatcaccatgcccagagagacttttcatctattcttctgagggcagctctgagagattacctaggacgctttatctgcatattaagacaaccttagttcactgtgaatttctgcccctcactttcccataactggtttgtccttccatcccattcagcgtccaaagagaatcatttacaaaccactgtcttgtctttgagcccattcattcccctaaaaatcatttactaccgctttaaaattgcctacagacctccaactaccttcctttctatgaagagagtatttaagtctcaaccatctggccctgagtctcatatctgcaggactgtcaggtccatgtgctcattaatacatttgtgtgctaaattttccctgttaatctgtctattgtcagtttatctatgcaggcttgaaccttcagaggggaaggagaaactctcttagctcctacacattaaactcagtccattataaaatacatttaaaattcaagtatatttagcaaaaataaacttttttttttttttttgaaatgaagtctcattctgttgcccaggttggagtacagtgttgtgatctcagttcactgcaacctccgcctcctgggttcaagtgattctcctgcctcagcctcctgagtagctgagacaacaggtgcacaccaccacgcccagctaatttttgtatttttagtagagatagggtttcatcatgttggccaggatggtcttgatctcctgactttgtgatccacctgccttgggctcccaaaatgccaccacaaccagcttttttttttttttttttgagacagggtcttgctctgtcactcagggtggagtgcagtggtgcaatcatggctcactgcagccttgatctcccaggcttaagtaatccttaagtaattctcccacctcagcctcccgagtagctgggactacaagtatgtgccatcactcctggttaattttttatttttttgtacagatgggggtttcattatgttgcccaggctagtcttgaactcctgggctcaagtgctcctcctgattcagcctcctaaagtgctgcaattataggcatgagccatgacacccagccttcaatcagcacattttaatattttgtttttttctcctctaaaggacaattttgataggatgtggggtaaaagatgaagatacagtgtagtccttgaagagtctataatctgattatgagaaaaataaaagcagataatatcaataaagtatggtaaatgtagttattgagaatatgaatttgcagtaagaaagacctggttgaaatcttagatctgctactttatggctctgtagatcttggctaaatgatttaacatttctaagcttgactgtccttaccatataaagaggctgtgactattgaccttttaggattgttttgagacataaatgagataacatgtgtaaagtgttttcagcacaatgccttaacacatagtctgtgctcagtacacagtaattattactactatcaccactaatgtttgtacacacttatgcagagtgtgctaagggagcccagaaaagagtacttaggttggcctggggattagggaatgtttcctggagaaaaggagagcagaactgtatcttaagtgaggtaagagtcagatgaagaaaggtaggaacaatatcccatgcagaggaaatagcacagtgcatgcagcgtattgccagtatttggcatttgctggcaggtctagtgcaagaatagttattcctcactttctcccttccttggtatcctacagcactattgcatctcccttcactcccttcactggtttgccatccatcctccccagaaatacccttgctacccctgatggctatgttggatttgtcctttaaggacaattcaatcctttgtaggtggaccaggcctctctagaaccctaccagaacctattctttccctctgtcttatgaacatgaggagagatgacctgcagaggtagtatagctaagctaagagtatgggctctggagttaaacttcctgagttcaaaccctggccccactactatgtcactttgagcaaattacttcacctctgtgtgcttcagttttccccatctgttaaatggggatggtaacagcacttatctcttattatgaggttgttgtgatgattcagtgagctgacacatgtaagaaaactgaaacagggcctggctgttaatagctattagctagcattacctaacaagattaaaaatctatgcttcatggacaggacatacttgagaaaataaagaatgcctcagattagaaatgtggccacctgtggagggtagaaggaagaagggaggataaaagaggaaagagaggaaaactaatatttactgattacctactaggggccaaaagtattgcattaagtgcttcatatatgtttttcacctgatccttacaacagctgtggtaaatagatggtattgtccccaattttatacatgagtatcctggtcctcagagagtttacaaaatttgcctagacaaataggatcagaattgaaagctatgggtaggcgagtagcagagtcatgctcttccaactgctacttctcttcacctccccggggctccattctcttagtttgaaaactatatcagacttcacattgctaagaagaaatctaggagctgcctaattttttaaatgattctctaggcctactccaggaaatataaacatgtgcttacattctaattttatatcctatgctgagaatttaataaaaataatgaattgtagcatataaactaagagtatacttccttgttcagaagttcagaatatattacaattacacattgacaataaaaatattttttagaactccaattctatgttttcagaaattataaattgactaggcttaaatttgttttgttttactttatttatttatttattgagacagagtcttgctctgttgtccaggctggagtgcagtggcatgatctcggctcactgcaacctctgcctcctagattcaagcaattctcctgcctcagcctcctgagtagctgggactacaggcatgagccaccacacccagctaacttttgtatttttagtagagatgggatttcaccgtgtcggccaggctggtctcgaactcctgacctcaagtgatccacctgcctcagcctcccaaagtgccagagattacaggcatgagccaccacgcccggccctacatttgttttataatatgaagcagggcccaatttaatctttaatttacatttcttccagcctaaatattatgtaacatattttgtgggcttttaatatctttaaaatggttcatatttcctagtaatttgagtagggtatcctcttttgtttcgtatgaaataacataatattcttataacaaaatgaaaataaagttaaagaaaaccatgaggtcaggtgtggtggctcatgtttgcaattctagcactttgggaggctgaggctgaaggattcctggaggacaggcgttcaagaccagcctgggcaacatagcaagatcctgttctgcgcatgaaggtagcacttgtagtcccagctactagggaggctggggtaggaggatctaagagtccaaggttgcagtgaactatgattgctccactgttctctagcctgggtgacagagagagatcctgtctctaaaaacaaaagaaaataaaataatactatagtattatggatgttatatatgtagaacgagctttttcatattgtcaattctttgccaatggagatgattcacacacacacacacacatcttgtcacatgttggcccttatactgataaaacagcaccaatccttcagggaagctccaaatactctatgacaagaagctgggggtggtggcagtaaggaagcagataatcttctatagagacattttatatacatatatacttatttaacctaaaaatatatttttttctttaattacagtttcccatataaccatcagtgggctccagcgatgcaagccatatttattagaggcagcatgtcaaataggagttgacaattacagtctctatcaatacatattatgccagacggtaatgagccatccacaaagggctagctatccaaaataatcatgctgctttccagagaaatgtcaaagaggttatggtttattacacagtgctcattagatatacagtggcagcattagcaatttttccttcatttgcgtctcatttaaggatctgcccccacaagcacagtcaaattagtacgcaaggttaaaaccattatgccctgaaaaaattaagttgcattttattttacagtaacggtggatcaaaggtccttggaatctattatttacagaaccattatctaacacagcatattaacaaaagggaaaagaaaagcaatgccctgccagcatggcttggacaggaacaaaggcagactgtttgaaataagcaaataccatgttacttaattaagtagccctataaaaactatttttaaaataacactaaggttgtgacatcaactgacaaaagtcacaaaattaaagttaatgaagtaccaacctgtactttaaaatgtcttgtttacattaacttatttttaaacattttaatactgtcattatatataatttttaaataaatttaccaattactctaaatacttattttcttaaaaggataacccatttttaaatttttatagcaaacccacatttatcaatatttaataaaatagaatttgcagatataactattataaccagaaagatgtgatcaagaaggcagatcttggaataagttacaaagatttaaataaatattgcaaaataatagatacttaatggattttgccaaatcagcagataactggttaacagcatctgaattactggcaggataaacatttgtagcaaagagatcttttgaagagatttctaaagtcctgattggactgttaataaaatatcaaaattcattacagttagaaggataatattctgaatgtactttccccacattttattaacagacctcagttgtagtgattattcaaggatcctttcctttcatttaatgaacacttattgagtgctgtcatgtcagaccctgtgataagagtctgagaattcattaaaaagaaaaaagaaagaaagaaagaaagcatatctctgtacttgagaagctcatggccaggtcagtgaagcatttggacaggaaaccaaatgatttgaatcttgggcaataattgctgtcccagaagaaaatacagcttgccaagggagcccagatgaagaggacctaattgaaatcttgatgaagtaaggtaaggattacccagggaagtaacagctaaagtgagaattctacccagtgagaactgtaggggagaaatacactgggaaggtgggcgaacaagtgagaggaggctggggcgggatcatttacctcagattatcacaatatacagttttagaaatcctttaaaaatgctcttcctaattagaagaaaacatcttgaagttggattgatggacttaatgaaataaagtcagcaagaaagttctagaacagtttggatcatgttaaaaaaataaaaagtatgttatagaaaaaattcctttgtcaggtccacatatggtcaaatttcagagtggatgaatgtattatccatttaatgttaactgtaagtctgatttaataacttgtcatgaccaaattttgaatttctgttggttattcttcttaatctttacccccacatgaatgaggtaagcatccttgtatctttccccttaaactgacaaaaggatgagctatatatacatcactttaatttttctggtatcttatatgtctagtatgtgtgtctactctcaaaacatctgtaaaatataataaacttttagacagcagaggacggattggtttaattcttttgctatggtatccagtatagctcaggtgtaatcagatacttacaaaaggttgcttttttttttaaatgtaaatgccattatattctagtacagctattatatatggctatggtctacaatatggcagattcctgaatggattgttaggtggttttgaggcatttagagtagcatcatgacagcatgatagtaatactcattttcctcttttagtataacagatttctttttttcgtgaatattgggcctttttaaacaggccctatatatctactctgatttagctttttaagtgactgccgttctcccttcctcaacagtgttttaattcagcagtatttaacctaccaacatttttcatttaatgaacaaaaaatgtatagactccaaagcttttttaaaaaacaaaacatatactacatctatagctttgcacatattgtgcacataaaactttgtataaatggttgcagtattattcctggctttgaattttgcttttcttctaccagaaaaagcttctggtaaccagacgtcacaaaaggtacagataatcataagatgtcaatcataatacaaaaacaagttatattgttgaactgcagaaaaagtaaaagcaactaggccccatgctggtcactactgctctacgttcatttcaatactacatgtaattatgaatctcaaggaacaaaccaagaacgagcctgctgagagtggagacagaggagtatggccaacctctcctccacggcacctcgcagcagtgtcagagcagccattttgtcagtgcgtctctttctttccactgctctaagatcttcagtttattcatttgctctcacctctgccctattccagagggtttaaatggtttaggtattattagatgatgttcagtaataacagaaaaaaagcacaaccagatgtggaggaaacatgagacaaaggtgtgacaagagatgaagtgtgataaactgagagggcacaaaatgggagggggccagggagagccccagagtgatgagggaatagtatgaactacagactttaatgtagctcccagaaataaaggcttcttctgtatgtgatgagcctattttatctcaaaatgtaaagctgtctgaattttaggtttgatgaccatgtgttctgcaaagacagcatatagattacaaccgtgcctgacctcccagttttaggaacaaagtggaattctgtcactggacaccatcagggctttgggttacatctccaactccttattctatggataaaaataaaagctcccaatataatattcataatttataacaataacatgcagatcaccttttaccgtttgaaaatggcaccaaattagtaatggtcaccatttctacagcaaaaaataatgtgagcactttactgcttgatggtactgttagattagtggtccccagtttggggtacgcagatctttaagggttatttacagtaggtaacaagttcttcacagaggtgagtaattttccctttccaaaatgtcgaaggaaagcaatgtattccccctccccccagataaagtaacatctgttaacaaaatttttaattttctttaattttgtactcattaataagatgcgacagtggttatcttgtggtcatcagaagctcagattggcagttacaagtgtatctaataaaatggaaaatcatataatgatgattttatatataaagtgcctggtaaagacgcttttttaaacaggggtgggagaataacaaaaggaatcctgagcggtaaacaggtggggaggttatcataatgaagtatatactggctaatttccctccacttctccttgaccgccccgcttctttcaccaaggcagtctaagaggaagtagctatctacttcaacaacagctctaacaggagaccagaagaggtcagcggagagcagtgctaggcacccatcctcccacccagagggctgagctccagaagatcccaggtctctgtttactcaaaaaagaagcaactatgaaaacagaacaaattgttttattcaattttttactttgacacaatcagagatgacctataagtctgttgtaatggttagcttaaaaaaaaaagatctgaagtagaaaatgaaaaaattttccttatataccaaaaagttccctgaagaagacaataaaaatgataatgccttgatagtgacataatcttattttctctgagatagctagcaatccattatttcttaaaaacatgagttgcaggtgcacaaaaattcccatttaaatatactcagttcatcggccgggcacggtggctcacgcctgtaattctcagcactttgggaggccaaggtgggtggattgcctgagctcaggagttcaaaaccagcctaggcaacatggtgaaaccccatctctactaaaaacacaaaaaattagctgggcctggtggcaggcgcctgtaatcccagctacttgggaggctgaggcaggagaatcacttgaacccaggagacagaggttgcagtgagccgagattgtgccattgcactccagcctgggtgacagagtgagactatgttaaaaaagaaaatatatatatatacacacacacacacacacatacacacacacacacactacacacacactcagtatctgattatttgtgctatggaaaaaagaatgtgcaattactaagaactggtcaagtactacagagtccctggtttctaaattaattctaaaatcggaaagtggaaaaattaaacatgttttttgaatgttttaaatatttaaatataaatgtttcttctcttataccttcagggagtgtaaaccaaatagaaagtttcccctactccccacatttaaagctgaagaattagaaggaaaacacactatataaacttttaaacaccagctgtagtgtttttacttgccttcctcagaacttccttcattgaaggtacagtacctaaaaaccagcttttgctacgttcccacgcaaatagaggtcatgatctggggtgttctgattgactataaacttgtagtagtataccaggcacagaaagaatggcaaccacaaaagacaacgtggtacctgacgttaggggccttatgaatttaataagggcattgataaaattagaaaatgctaaggaaagacctaaaatggatgaatatattcaacagataacagagaggtccaagttaccttgcctacccctctaattgtttttgaggaagatcaactttcagccaaagcgctgcagacaatataaaacaaagtttgcataaagtacctttgaaaataacaagctgcctataaaccgttgcagacgtgtcagtaacaaaggttttgcaaagttaaagccctaaattgaattaaaccctaataattttgtattattacattttcattccctgacaattctgatttttcagcttactgtttttgttaaatttaaattggtctggtctatctatagagagagataaaaaagcaaatccctattttttaaagttctgagttgaatggtataaaattaaatacagaaatgcattttaagtgcaaagtatccttccactgttgccagaaaacaagtaacaaagaggagttaagtaatttaacagccatattttctcactcgccttcattgggaacacagtcgtttgcatggcataataagctgtaaattataaacatttttacatagcctgctgcaaagaaaagtctgccagctttctactatattggatagtgttcaagtgattaactatagctttggaaaaaaggggtggaaacttgttttgcgtcgcagtttgttggttctcacgtacagcctcaaaaaaatccattacatcattatttgcaacaaatatgtaagtaattataatagagtaatagaagctccatattattacaggatacaaattactcatggacaagagaaaatcttgtaggtgcataatcattcaagtatttccttgaaatgttgtctctaatgagtatgaatgtaatggtttccaaaaataacaaaatttgcagcactgacatttcaggactaatgacaaatgaaatacactttactctttgtctatagggaaagcccattagacagaatatctgcttagggcacaagtctattttaaaaaaaggttcttgtgtcaaagaaaatatataaatatctgtgtttcacaacatataaagaataaatgtgtgaaaggaaacatgcagtaatagagataatggcctgcaaacataaacgtttttatttttaaattatatagagccccaccaaaatccacattcaaccccctaagaaaattttgtctcaataaatcaacaataatacatggagcacttgagtgcccaccatagtgctggggctttggaggtcaaagaaaaagtttataacctgatgtctgtccactatactgaggatgtcaagatgactaagaaagtatatgtaaggcaccctacttcataggttgtctacagtaatggaaagagcatgaattctatggtcaaatgggatttgaaactcaactctgtgattttcttacactataaacttgagcacgttattaaatttctttaagcctgtttaccaagaaaagcaatttcttaaccaatgttaaatgttaaataaatgcactaatatatataaagaatatggaacagtagcagacttatagaaaactctatatgtgttagctatagtaataattatatttctatatttattatagttagctttgcacacagcaggtgttcaataaatgtttgttgaatgaatgaatgaatgagcaaaggaacaaatctagcagagggacaagataaatatgcagattactataaaatagacgagaagtgcctcaaaggtacaaaatgtaatagaggcctcagtggagggagaggtgataggttggaagatgattaagacacaaaccctgacttctagaaggtactgtttagtaagaaaacatacataaatcagtatttacaaaacagtcattacaaacaatgtgttaagtgttttaagatttcacagaacctttcttctatgttctagctctaaatacaccacggcttttcccggagtgtccaaatcctatatgttcatgagcagatatgcctaacttctacaagccacaaactgaggagctgagaggtgggaccagtgctcagtgctccccttatttcctcattttggtgaaaaccactgttcctttgaaaccagctctacttctgccatcactcctcttctctgtgcctctacatttattgaagtctcagttctgttgttctggttgacttcaatcatgtgaattgcccaccctacagtttttcaatatactcaattcaaccacctccactgtattctgtgaaacccactttaaggcacaactgaacataaccaatcagaactgttccacttttgaaatctccacttggatatccaactttccatctaaaacctactgtcttttctgctctttcattgcattaccacttccacccctgcaaactgattcatcatgatctccagtcccttgatcactactttctctctagttttgggctccctcaacctcacttcctacctgatggggcctaaacaatcatattagatcaacctacactcttgcacatacccttttcttgatgacaaagaaaaacattaatcatgcttttatcttcctcacatccactctagggctgttaggaattgcctgttgctgtgttaaggaatttgtatctaatcctgtagggaatgcaattgaagagttaaggatgttttactccacttaaaaacttgaggccaggccaggtgtggtggctcatgtatgtaatcccagcactttgggaggccaaggcaggtggatcacttgaggccaggagtttgagcccagcctgaccaacagtgaaatcccgtttccactaaaaatacaaaaaaatagccgggcatgaaggcgcacacctgtaatcccagttacttgagaggctgaggcatgagaatcacttgagcctgggaggtggaggttgcagtgagctgtgatcgggccactgtactccagcctgggtgacagagtgagactatctcaaaagaaaaagcaaacaaacaaaacaacaacaacaaaaaaacttgaggccgggtgtggtggctcatgcctgtaatcccagcactttggagagccaggtgggtggctcacttgagcccaggagtctgagacaggcctgggcaccatggcaaaaacacctctctacaaaaaatacaaaaacattagccaggcatggtacatgcacctgtagtctcagctactcatttgagcccgggacattgaggctgcagtgagccattatcgttccactgcactccagcctgggcaacagagggagaccctgtctcaaaaaacaaaaaacaaaaaccttgagaagaggagggaatgagggaaatcttaacaacagaaaagggagacttaagattccagtaactatagagagggaggatgccaggattagagataaccaatcagagaatctgccctctttgcctctattatcaacaccacccactttcaggagtgagaaggaaagtccaagagcacagtgaggaagacatttcttaggcactaagccacctacagatgtcagctctcacctatcatcttatgtgaggggtgttaaagactacctacctttagttaaacaaagggtttatcagtggacatgggtggattgtgaacccaatggtgactgtggaaatagctctagtagttaagttccagcaaaagagttttagaaaggaaattacatcaatagcaagtgtcaggaagactctagatgcatacattgtttccttacctactcatttgaggtcaaagactatttcttattcataagaaatattcagtgtctttcagtgtccagtgctgtgccttgcagagacaggaggtggtcagggtgacttattctggaccacaggatagttgaacctatctagatgtgtaccctgttagttaagctcctggtttgaagcccatcattgcccctgctgtacagatgagtaatttcaaagagtgattaagtaacttacttaaggtcaaatagctaatcaattgcagaattgagacaagaacccagatctctggcccttcatctatgcctttattatgacacactgtttaccactgagatgccttccgtatgagttcaaaggatcaccattaagtcatgaagctactaagctgactctgccaataaaattaatattttaagtgatttgcacaacttctatcacatgatgaatgcccaaaattaagcactgtttaaaatgtagaattagtcactggacagtgcctttaactttggctacttaccagtcaacatacagcccttctttaaggaaaggattttaaaattttttactattaacaaaaacaatttatgcagcttgtgttttgctgtgatagattaggcaggctaatctatatcatgttatttacatgcaataaactaactcagctgagtagattagtaggtaagcccacctactttttgtggttaattatactgttttgtaagaagctgatcctattttgtgtttttccaaaagctctggtgaagtaatgacttctgacgtacagtatgttaaacataaagagccttcccttttctttctcaacatataattgctgcatttgtgcatgctgtgcaagttgaacataacaataaaaacttaatgaagaaaataagtactggttgtaatgaattagtaatattactagatttgtatctggagtttacatttactgttgtaagtagaatacaatcaataggaatatgtaatcaaattgcacatgctttcatctcttgagatttatctgaaaaggagctgagatatctttaggaaattatttccaaaagcctacactaaattcaattattctgcataatcatttaaaatcactgtcaataagcgctcctcatttttaaggttcttgtagtacaaaaagatacgtttcttaaataggcttttattgctttacaagtatgaaatataactttttcatttttaaatttagttatacaaaataacatgaataggttattaaaaaactgaaatactacaaataaagtcacctttagaccattcccttatatctgtttccaaacctctccaaccccttctttcttcaaccactgttattagcaggtgagtaaggttccttccagactctttgtttgcattcacatgttatcttaaaaacaaaacaaaaccataactgatttttaaaatgctacatatttgaatattacctatttcatgtttatataattgaccctaaataaataacatgatcaacatgttctgccttaagcctcatttcttaagatgttttttgatttgatcagtccccaagggaaatacagtttgttaattttgtttggcattttgaagtgctagacgaattctaatgtgtggaatgaaggtgaggatggatagatagtcacagcctattgttactataattagaagtcgtcagatgctaattagtaccacattaaaatgataaattatgaactacaatatttgcagctgagaccaagtgcaattccctaaatgtaaaggtttatagaaaaaaaaacggcctctttcacagctttttatattctcccttctctccttaagattatttcacacaggcctccaaatattctatcacttcctctaacaccacactaagcgtaaccaattttcacttagaggagaaagtaatgttaagatctgtaatttgattttaagatgtttctagatttaacttatagttatgtttatgatgatttttgtgataagttcttgaagcccaacaattacctcagtatgtacaggtgtttcttgacttacaatggggttatgtcctgataaatccatttaaaagtcagaaaattttaagttgcatcatggtaagccagggactacctgcatatcattaatttaaccttaatcaattgaatacaccgagtagagtgaagaattagcacaaatgcgaagaaattgatggtgtccatttgaacagatggcaaattttaaaaagctaatctaaagatagcattttacttcattcctgctttttttaacaaaaataattttttttatactttattatttttatttgtagtttatgcattttcacaggatatttgatctggtcaaagaggccaaaggataaaagttcaggtcagcccagggactccaaagccctcattctaattacaggatagggtttctaagctaactacctgttcatgtcttttgtccatgtttgtgttgtaattttcttcttcccgatttataagattttcaattgatttgtaggttacaacttggcttttggtcatgtatgttgtaaacatttttgtaatttgggctttgtcttttgacttcatgggaattttttccactgaagagttattttttgtgcaaatgtgttaatcttttcatttatagtgtcaagttttggaactttttcataaagtcctccctgctctgagataaatactaccactactagtgacaattattcagccatgatcaaatagtcattgctatctatatgctagaaacatgctgaatgctgaggtaatacggataaaatacaattatctgaactatgttttttcttttttcttttttttttttttttgagacagagtcttgctctgttgcccaggctggagtgcagtggcacaatcttggctcactgcaacctccgtctcccgggttgaagtgattttcctgcctcagcctcccgagtagctgggacttacaggcaggtaccaccatgcctggctaatttttttttcttgtattttagtagagacgggattttgccatgttggccaggctggtctcaaactcctgacctcaagtgatctgcccatcttggcctcccaaagtattgggattacaggcgtaagccactgcacccagtccaatcatctgaactatgtttaaaagcacatagaggacacagtcttctcttatcagcattacaaataaatacagaaaatgttcggtcatgattttcttcttattcgccaactcacctgccacccagaagtcacataggtaataagataaaaatagttgttttggctgggcgcagtggctccgcctgtaatcccagcactttgggaggccaaggagggcagatcacttgaggctaggagttcaataccaccctggccaacacggtgaaaccctgtctctactaaaaatagaaaaattagccaggcgtggtggtgcagacctgtaatctcagctacctgggaggctgaggcaggagaatcatctgaacctgggtggtggaggttgcagtgagccgagatcatgccattgcactacattctgggtgacagagcagggctctgtctcaaaaaaaaaaaaaagtagttgttttacagatagaattggtatgctttaaaattggtcagtatccattatgtatcctggcaaatagaccatctaaaaagaagaaatgccaacgatgactttacttctcattcaattactcatttaatgttttttcattcttgcatattctacttgtacctgaattgatctctatagcaaacagattagagacagagcaaggtgggtaaaaagaaggtggctacacttctataaatgaatatgtgtgtcccaggacactgcagatctttaattcaattcagtgtttttttcctcagattggcaggtgtgtctcgcagttggatgtggtccagcaggtccctatgctgcaattctgaagcagtgggaacatcatcattgcactgggtccccagcagcagcatattctctacccactgctgcttagaggaaatggagttaagggtaacacaaactcaggagagtctaaaacctatcagtaaaacttcaagacttatagataccagaattgaagctgcagataacagaggtgggcaaagaaagtgtagtagaaaaaggaattggttgaaatatgaaggaaaaataaaataaacttttgatgagacttaaaaaatttccctggacagggccaggcaggctggggtgcagtggcacgaacctggctcactgcaacctccacctcccaggttcaagcaattctctgcctcagtctcctgaatagcagggattacaggcgcccaccatcatgcccagctaatttttttgtatttttagtagagacagggtttcaccgccttggccaggctggtcttgaactcctgaccttgtgatccacctgcctcggcctcccaaagtgctgggattacaggcatgagccatggtgcccggtcaacacttttcttttccttctttaaatatattatattgcttcacataataactagcttaaaaattaagattgtttcatgaagaatgctttagaatctggttatagctcacatcctgaactacaggttgcaaaggacataataaactgccatccctttaagtcatcgtccatgttaaactactctgtaagacttacactgtaaaacatgtgtttcaaatgtttgcgtcagtctaaaacacttatgttatacagaagatccagtcatccagatagagatttaaatgaatactatgtccaaggcattggtgagttgtaaaggtatacaaagctaagtgcctactctgaaggagtgggaaatctaataaagaccatgaagcagcatgactggggtctggaatggcaataataaaccacatttggaagcatattctatgtatgaggcactgttctaagggttctcgatgtattaacttatttaatccacttaatagacatgaggcacagagaggttatctaacttgtctggggtcacacagctagtaagtgatgaaacaaggatttgaacccagacaatttataaccaatatacatatttcttcctctacttgactacttaatgtgggacctcggaaagttacttcacctgagtctcagttttctcattggtgaaactgttttcttttcttttcttttttattttagtagagatggggtttcaccacgttggccaggctggtctcgaactcctgacctcaaatgatccacccacctcagcctcccaaagtgctgggtttacaggtgtgagccaccgtgcccagcctgaaactgttatttctgcctcacagagttctcattaggattcaaagttaggcatgctgatacagagaaacatttaccaaacttttgccgctttccacaaggtgtactactactgacagggaccaatgggttctgtagtcaaatgactgggaaacaatatctcagagtcatgatacataaatccgtacctaactcctaagaattctcaaatgaaggaatctctctaactctgtttaacctggcatgcccacacttatttgatcccagaaccttttgtcccactgaacacctagttacaacttaagctctggaagaaaaattggtaaatgctaacaagaaaaaggcatgaaatcaaaggacccagtgggttcaggtctggctcagccaatttttaactgcttgctatgggcaacagctccaacccctctccatgtctctgctttccctctcagcttttgcctagacgacttcactaattccctggctgactctctatcttggacctcacctctcagggtcaccttctaagcgtcagctaattatgttccatagcacagatacagtaacatgaccccttttgcttaaacacctttttgataatagctaagaataagagcaaacacttacagaatgcttactatgccatgcagtattctactcactcgtttaattctgaaaaccattctgtgaagtacatactgaggtgcggctagcaggtggtgcagtcagcttccagattccaagtccactctgctgcctcttgaactccccacaatttatccaggatatcgccctaattcctcaggcccttcacagtgtgacttcaacctttcctttccacctcatcttcattccctgcttctcatatatgagtttctagggctgtgaggctggcctgtagatggctgccttcagttcacagggcattctccctgtatatgcatatctatgtccaaatttcccctttttataaggatgccagttatattgagttagggcctattctaatgacctcattttgacttgattagctctgtaaagatcctttctcctaataaggtcacattgtgaggtactaggggttaggacttcaacacatgaattttgggagggtaaaattcaatccataatacctgcatacataatgaagctagtctcttttccataaattcatacaatcatgtaacagttatgtactgagtgcctattaattacaatgttggtactgttctgggccctgctaggtacttctataccccacgtctttgtgaggtatagaagcagggtgcagtggcgggcgcctgtaatcccagctacttgggtagctcaggcaggagaattgcttgaaactgggaggcagtggcttcagtgagccgagactgcatcacttcactccagcctaggtgatagagcgagactctgtctcaaaaaaaaaaaaaaaaaggaaaaaggtaacatttgctgctgtcaacagataaaccctaaaatttaagtggcttaacaaatagatttttcttctcatacatctagtctgtatggatgttcctgatgggcaggtgactttccttcaagagtgattcagggacacaggcaactttcatcttgaatgggtcacttcccagatcatctgcttaaggagtattacagatgcaacatttttatggccaggaaatagtaaatatcacttctactcctactctattggctagatctcagtcacatggccagccacctgcatgggaagctgagaaatgtagtctagccgggtactcaagaagaaaagaaagtgcgtttggcatacttgcttcagtctcttctaccagttaaggtgctgggaaacttcaggaaatgaaagtagagtgcaaatatgttcagtctgtggtctgcttttaactactagttagaagagaagattgagtcagttcttgataaaacaaccgagaaagtggaaccatcagccaaaatattcacgtgaatttctgtaaacttaataatcatatcatgagaaaaatctatagtttttaatatgcattatatattgtaataaactatcttttgtacacaaaataaaactatgctattactaatagaatgggaagttgtaaacattttcttgattgtagctagggataactgtaaatttagtaatacttgactggctttgcaaccaattttttaaaagtcaaggttagtggaataaacctaaagttcacagtcttgttggcaaaaggctatggcgaatgtttacagtacatttttataaatgtggctttcttgcccgattttcaaaatgtagttattacattttagcctaaattctgcctctcctggctgttatatgattagttcactagacatccacagcaccaattatatccttaggccaaacaaaagagatcacctaactcccatttggtccttcaggtaatttactcaggtcccgttatctgatatcaaagtcaagttttatgagagaaaaaataccaacaaggtaaatcccagtagtttggaggtgaattaaaaagctcccaaattagtacttccctcaaatgttaaataattcactgtagcattatagatacaagactccagcaaaagttacacttgaacaattaaggaagcaagagctaaacaaatgacttcaggggtagagaaacaaattaatggtttctcatagcactataccaaattactttttcacattaacaagtgtgtaaaacacccaaacacccccaatgacctactagatgaagtttgattatagaaaatagcctgggtttacatgccaggattattccctaaatgtaactgtggattctatacacttgagtataaagcccatttatgttatttggaaaggtttcatgttcacaacgtacccctactcttttccaaagttcttttagtcaaattgcttggattataatgaccatctgccaacatgttatgtgaaggaccaaaagcaatgaaattgtttcctagaggctagacaagaattagaaacacaaggttacatcacagtgcaccatgtgcatacagattaatagctcctgctgagtagaaagagtatacactttgagataaaaatgggatttcaatcccaactctatcactttctagctaaaatatttcagataagtcaacctgagtattagcaatctcttctgtaaaataggaataacttacttatgtaacaaatatttattgaatatttactatgtatcaagtagtattttgcaaggattattttaggattagagataaaaaaaatagtaggtgctcattatctgtatgtgtggttatccaaatatacaagcagatgactaataagaaagggtcaaagtcagcagactgaaaatcaatggaattcctaaccgaaaacagagatatatgggatacaaggcaatgtgaggtccatttgctttccagggactaacaggtagttagtactcactctaaatttttatatattttctctagttatctcaactaaacttagccaagagttttctacaaaatttataaggtaaacttttttttttttttttgagacagggtctcattctgttgcccaggttggaatgcaatggcgcaatcttagctcactgcaacctctgactccaaggctcaagcgatccttccacctcagcctcctgaatagctgggactacaggcacatgccaccatgtctggctaattttttatattttttgtagcgactgggtttctccatgttgcccaggctggtcttgaactcctggactcacattatccatctgcctcagcctcccaaagtgctgggattatgggcatcagccatcacacctggcctgtaaggtaaacttttgagctctaactcaagcaggttttgggaaaggatgtagatgtactaaagatgtgccaaagagttttccatttaaaagtttttaaagatatgcttacaagatgactttttttaacatactaatttaatgctagtctgatctataactgaaatacatatatattttgaaatagattagaaaggtagaatgtaatcaagaaaaaaaaaaccaacaatgaggtttggagggaacatgagaactacagttagagcttcaactctccccattaccagttgtgtcaccagaaaaagcctcaaaatttttgaatctgttttcttgagtaaaataagcttaacaactcttactatggcattattataagaaccaaatggaatagctgtcataaaaatgcttagtaacctaaaagcactaaacaaatatgaaccatttcagagtgaataggtgatcacaagacatcccttatagtgaagggtatttgtatggatgaatggtaaaaggtttacaaaaaattatattggctggaggaatgggcatttgtagtcacaacagtaatcatttcgcttgcttgctaatgaggaaggatcattgaatttctggctggcaagcaacagtaatccctaaatattatggaacagaaaacatttatggacaagaccactagaaataaaatttaaaaaaaatagatttatttttaaagtaaatcaacaaggtcaattagccataagtcaaagttcctagaaatgcttcttcttgtgaggaaaatttctttatcacccatattgttaggctggttttaatttcatatgccaaagtctacctgttgattgttacatctatacaggcttttaatacagtgccaagcatattgctagaattaagtaaaattattgctgacatactgttactaaaaatatatccagtgatttttttaaacaaaactgaaaattttaagtttattttatatgcagcaaaaaatgagtaatacatacttacaaatttgttttttaatctaaatacatgagatgtaaaaattttttaatccaataaccagtaaaaaagtagactacagctcttaaaatgacagtagcatcaatctttatacaatgaggtattattttatcttattttattttgagatagagtcttgctctgttacccaggctggagggcagtgacacgattagggcttactgcaggcttaacctccctggcctcaagcaatcctcctgctttagtctcctgagtaacagggactacaggcacataccaccacaactagctaatttttaaattttttgtagagatgagggctcaccatgttgtccaggctggtctcaaactcttggtctcaagtgatccaccaggcttggcctcctaaagtgctagaattacaggtgtgagccactgtgcccggccaacaaggtgtcattttgagtagatttaaaaatcatagatcctgaactaagtggcacagaggtctctacagagacacaacaatacataataaggggagggagaagtgatgaacagaaaattttaaatgcccaaagtagaaaggaaagtatttcacacaaatgtgtgaagaaatttaccagagttatgtgtagagttggccaagactatcacttattatgaacaataaaaatccatttttaaccttatattttaatctatctttgaatcagagaatgacaaagaatggtgatttccactgacctctgtccagtaaaagaaaacacgatgtagagagcaatgtcaaaagactaaattcttcttaccatgagtagatcccactgaccatgtcatagttctgacatgaagtgttcacgctgctgggcccagctgctttagagataaggagcaccaccaagcccctcaactggaggctattccagctgtcatgtacaagccccctgccaacaagcaaagaaggaagaggattaatataccctcacgagatcatcagataacttagaaaactgctacaaagatgcccacacttctaaaactggacaatgagacttactgaaaagaaacagggtcagggaggaaaattaatgtgaggatgccatgagttcaggaaacaactagagaaatctacggctgcgttgttgttgttgttgttgttgttgttgtttttgagacagggttttgctctgtcacccaggctgagtgcagtggcacaatctcaactcactgcagcctcaacctcccggtcctaagcgatcctcccacctcagtctccctagtagctggaactttaggtatgcaccacgatgctcagctaattaaaaaaaaaaaaaaaaaacgtagagtcagagtcttgctatgttgcccagactggtcttgaactcctggacacaagcaatctttctgccttagcctcccaaagtgctgggattacaggcgtgacccaccatgcccagcccatggccagttttaaaagcgacaatctcgctggtggcagtggctcaggtctgtaatcccagtgctttggggggccaaggtggtcagatgagcctaggagcttgagaccatcccagacaagatggtgaaaccccgtccttacaaaaaatagaaaaataagctgggcatggtggcatgtgcctgtagtctcagctactcaggaggctgacgacggagaatgatttgagcccagggttgggggggtgctgaggctgcagtgagccatgatggcgccactgcactccagatggggagacggattgagactctgtttccaaaaaaaaaaaaaaaaaaaaaaagtgacaatctcacatttgaggcttcctcatttgctctctcctctttctgggtctccccgctgtctataccctatctcacaatcttaatcatttgctctggtaacaagaagaacccatagttttaaaccggtttgtgacagttgaaagaaactgacatataaatcacattgcttggatgaagtgatactatttggtgatgacggtggtaaacagtagtaaaaaatgatttgttttcacaggtagagaaggagctcagagaatgaaaggattaaaccaaattcaaaagacgcagaaatttgataagtaaatgaaagtgaatgccatcagcaaaaatgttgcttattacttacaaacattataattctaggcaacaacaaggctttaacttagaatgtggcatatcttttgacatgaggactgaatttttataatttctgctatacctgaggctagaaatacttcccaggaatacattttctttttaaagtattacaaatggttgtcattcaagaactaaatggcattgttttaaaaaattagaaaactatgggcaatatattacagtaaagtcatattgagaacaatgctcatgagcactaatcaaatagattacagcatatataaataatatacaaatatagctctcgaatgcagtaagaaaacaaaaattagtgttataatacttgactgaattatcaaggcttccttgttgagtttttgaacaaagaatcaatttaagttaattaaggtaacatagccaaaaataatgaattagtccattacttaagaaaaatcttggttgggtatggtggctcatgcccggggtggggggggtggggggtggggcatcacctgaggtcaggggttcgagaccagcccggccaacatggcgaaactccgtctctactaaaaatacaaaaattacccaggcgtggtggcaggtacctgtaatctcagctactcagggggctgaggcaggagaatcgcttgaatccaggaggtagaggttgcagtgaattgagatcgagccactgcactcccagcttgggtgacagagcgagattccgtctcagaaaaaaaaaaaaaaaaaaaggaaaatctttgcccctccagtctccaaacagaaatttttaaaaggggccccttttacctttcattagtttcaaaataagacaaatcattaggttctctgcaaagtaacagctatagctttctctgcttatattctgtccttaaccaagtaggcaatcttcatcaagataaaagggtttaaactgatttttaaaaagaaattctaatttcctaggaaaaggaagttaaagtaatacagttacatcacaacagaaacaaataatcatcagaaatgtcccaaactctttactgtcatgtaacaatctgcttaaatcctatgaacctgaattttacggcggttaagaggcatcctattacagaacacaaaaatgttaaaagaagagctttttaaatttttttttgctttgaattacaacttttaacttaggctactagattcttatttatgtattacctatagtgaatctttattcttcctttcttttataataaagagaaggtctgaattggctttcaattctagaaaaggaaaagaaaaagaggtgtgtggtgtgtgtgtgtgtgtgtgtgtgtgtgtgtgtgtgtgtgtgtgtgtgtgtgtgtgttcggggctgggcctggtcagggattaaggatatgattcagcaagaactctaagaggtgaaccttgagacaagtctgaccaaatcacacagatttaacagccctgacaacagttttaacaatatcttcaaacttctcagaaataggacctttcacataccacacacacacacacacacacacacacacacacacacaaataataataatagcagcagcaaacacttatattgtggtttatacattgctttctatatgtcagaaactgttctacatgttttactatatattaactaaattaattcacaatgctaagaggagggtactacaattatcctgattttacagatggggaatgaggcacagagagaaatcaagtaacttgtctaaggtaccatacctggtaggtggcagaaccatgacagagccaggatttgatcccaggccaacaggctctagagtctacatacacttttaaacattatgctatgtagtgatgctccatctgcttcctttgtacaaaaccatttgctacatcaaattagaacagttggctttagaaccagacaagcctaggtctgaaaaagtcttctgttatttactagctgtgagtgtgactctaaggctatgacctcttgtataaaatgagggtaacaatgtctacttttcatagtcattgtatggaagagacaacataggtcaaagtacataacactgtggaagcacatggttggtgatcaagtaatcagtaaattacattttctttccttgttacttttttgtgatcttatttttttctcaactcttaacattttctttcttctactctctttctccttgtaactctcaaaaagtcttccccactctactagcatatataatctcctatgttatttagttttctacctcctcaaataacaaaagttaaggaattcttcccaccccctaatcattattatcattatctcaatgataatcatgaaaacacccctttcagaatgcattactgaaaaggtcaggaaaagaagctgtaatgaactgggtgacaaaaattaagagagcattcagaaaagcacatcttctggccattaattttcacataagtcagtggttaacaatctggaggatagactaacagcttgagtaaattaaataactgtttccaaaacaccatttctttaaattcacttcgttaacactcttaaaaaaacagtactgaaataagtggataatgcctacagctcaaaatttagctcacaaccaaaagagaatatgaaattttgctccagagcaaataaaaaacaaacaaacaaacaaaaaacatgggattctaaacttacagagacaatatgtttcatgtagcacaggtcatatttcatctggaacactctaattttttctcagtgcttctcttaagggacactgacaagctgtggcataaccagaaaatggtgaaatcacataccaccacatctaggaaggctagcttagaaaatggtaaggttggtgttctcaaacgtattcagccaagagtgtactgaatgctcactgcatgccaggcttggtgctaaacagacagtggagaatatgatgaggagcactgttaagatgtggcctcccttcttgtgtatagtagtctggatttaaaaatcacaataaaatgtggcaggaattgtttcaggggatgaataagggttgtggcagcatgtagaagaagcaactaacacaattcaggggatgtcaaagagacttccgtgagatctaaaggatgagtgagagggaagtagccaggggatctggggcagggacgaaaaagtgttctgaagagagaaacagtatgtgtggaggtccgaaggaaagagaggaggacacagttgtttctagagccagtgtggcaggaacacagtacgtaaaggaagaactgagagaaataaatctggaggggcacaggagagttgtctgttcttttaaaagggttccctatgtagaggagatagatctagtaagtattaattttttttttcttttagagacagggtcttgctatattgaccaggctacttttgaactcttggcctcaagtgatcttctggcctggcatccctaagtgctgggattacaggggcgaaccactgagccaggccgtaagtattactttagagactgatgctaatggacacaaactatagcaggccaattctggctcaaagaaataaaaaacagagcaacctctggtaatgctgagctgcttgttactagagatgtttaagaagctgcacggactctgacataacacattagacagaagcctggaatatgtgacatctgaggttgttttcttactctgtgattctatatggcctcactttactacatttaattatctaatactccacaatatatacaaaaattgaaaaagccttgtcattaaagtgtcataaatgaaagcagtatttagtattttataatctttatcattaaagttctacagaattgggttttcttagctaatgaacaaaaacatcatttgttcattcattcattcaattaataagactggacgccttctatacatcaagcattgtgctaggcatggatgcaatggtgagcaaaaccaggcatggagcttgcagagcttatggtctaatggaagagactggtaataaaaaacgaatcatgaggacgtgtaaaactacactggtaatagatgctacaagggaaaaagagcaagagtgccatgagagcttggaatacagaaagtaactttgcaggaaagtcagtcttccttgaggaagtgatgactgagttgatatccaaaggaaaaaaagggggagtgggaaggaaacaggtaaggggggtatatttgcagcacaaggaggggcatatgccaggctgagagcactgtatgaagtgaaactggtggcagacaggaactacaccacccaggatgaacagaccataagaggtttgctctttatccaaagagcaattcaaaggtgctgtggtattttattaagcagccagtgacataatcagatatttcagaaaacaaaacaaaacaaaatcatttatcatcagtgtagaaaatgacttgtgtagacaagagaggaggaaaccaagggagtatgaggaacccaattaggaaacttttgtaatagtcaataaaaaaaaaaaaaagagggtagcttgatggacaaactagagatgtaccaaacctaaaataatgttgattcaactcaaaaagatgttgcatactacatagtcctggaaaattagctaatataggcatatcactaattttaaataatattattctaaatatgtttgtaagttgaattttaggtggggagatcttggcctcctttaaagttcttctctagatctataatagataaagagtaaacactaataacactaatattctaaaagctaaacaatttcatgggaataaggattgagtaggtaaaactttgggcaagtcagctctgtcttctccattgtactttagatggctgactgcagttctcactgcatcatatccttccacagctactaacaaatttacattccttcatccaatcctgtattagatcctcaaaccaccactgtggtacttttctatttatcctcttaaattccacttcaacacgtatgaagggtatacaaagaaatacgagctgtaagaaaagagctataatagtagattcaaagtatggttaaattgaataatacaaggaacagataacaaagaaaagttacaagcagctatcagtgcacaactagttgctagaggtgtccctcacagtagaggcagcattcagattgagcctgaaagatggtcaaatttccctgagtagggaacagaagtaggagacgggactggaatggagtcatgggaatagaaagaagggtattttaggagaaagaaatagataagcagtgacaagaaggtggaagaacacagaaccagttcaggagctgtggggctacccatttgggcaatgtgtgaaggtaaaacaagtccaggaaaacagacaacctaaagagtgaagggccttgaaagtcaggtttagagtctggacttaattctgcaggaaatctggaggcataagtggtttgtctgcaagggagaaatgtaattagagctaaagactaaaactgttactctgagcctaatcctgttactctggcaggtgctatgttgtgtacggtggaaaggagaaggaagatcagttaggaggagcctcttctagtagtccagatgggagataatgagggcctaaatgagggtagtggcaatagggatggggaagaaaagctgaatgatggcagtagcatggaggtggaaaaggctagtgtggccaactggagggatgaaggagacattggggagggatcagaaagcaaaggaatgtaagattccaacctgtttgctggaggtgataatgctaccgttagtagagattggaaagaaggaggagaactaatgaggaatgaatgagttcagttttggacatgttaactttgaatgcaagaaggacttccagatggtgatgccaagcaggcagctggaaatgctgtgcctatagagttgggaagcatcttcatagaagcgatggctgaagctgtaggaactgacagatgagcttttaggtgagagagaaaagaaaagaagagaagggaagggaatcttggagaattcctacacttaaaggaatgagatgagtaaccaacatgaagaaatatgttctagctacaaacaaataaaaggcctccacagacatggataatgaagtatgtatacacacgcacaatggaggcagagaactacaacagtacaatgcacagaaaccagggccagtagttgtaagcttcttccatgggctttcatggacttactataaacctctagtttggcacttaacacactgagtaataaaaatggtaacaatataacaacaactataatatactataatgccaggcatctgctgttttacatgcatatgctctaattctcacaaaaaccatgcaaggtaactagtaatatccctttacaaatgaggaaaattagcatggaggctcaaaaaagttcaataattactactcacaatagtcaattagtaacagaggtgccaaaatttaaacataattggactccaatgcccgggcttgcttatgctttgaggccttggtatttaattatttgttcacaggactccctggcaaggttgtgagacccttgaaggtactcagtcctctttggatgccctgcacccagcagagcaactgacacagaatagttctaaaaaaaaaaaaaaaattaaagatgagagaatgaatagcttcaaggagtaggccagccaactctccatcttacacatctccccaaaacagacctactactattctcaactttcctcatttctcttcctgttatcaatttgccacatccaaccattcagctctgactggttcctcttcctcttgagttccttttcctaaattgtagtaagttctttgaaagtgacaggcacacacaagaaaagccccaacacattctaaaaaacatgctgagatttgttattttgacgttgtattttaaaaattactgtatataaaatgtatgccgtatcaaagggtctatttaagttttagagaaaactcaacatattaattatatatttaatacaaatatttatgtgttttgtttcttcatttaggagaactgactgaattgactgctgcatcagtgcttgggaaagaaagctgccctcactctgaaaagaagataagtgtacttccagacagagagttgaggtggaaagacagaattggggcataaaagaaaaattttgagatttatgaataagagttcaaaattctaaattctatcagcaatccaaattacaatcttttgataaatttataatcaaatattaaggaaacaacttcaccaccaccaagggaccatcatccttgagtaagctcaaaataccccaaagtaaaactgagtgggaaagaatcaccttgagggcaaggaacccctttcaatgttaaaacctagagatatagagtgagtggtacgattttatttttatttttttaatttatttcttttttaatggagatggcaatgttgcccaggctggtctcaaactcctgggcttaagtgatcctctcgccttggccttccaaagtgctgggaaagtgagccaccacaccaggtcttactattttattaccccactttccataaatccagttccagtaagtctatccaaaaaatgtaagcacaaaagatggatgtcaaattctaacatacatgaagtgggttgattggtaagattcctattaatgcttatgactgtgacccctagttaaattttttttttcatttagatacagacaactgaaacaaaagaattgactataatgtgcacagtttctgccaaagaactacaggaatactctaatcttttctactcctttttaaaatgctgactgcaacctgctaaattgatttgtgacccaccaacaaggtgcaactgtagtttttttgaaaaacagtgttttaagttacagtatatgatgtattagttaaaagaactgaaaacataatgtaaaattaaacaggaatagaatcatcactttttaaaagcagaaaatctgtccacacactagcacaaatttagtgttgcaacaaaacattaacgtttacttaatgacatgggaaaatactaaaaatgttaaataaaagaatacaaaattgtatacatcatatgatctcaattatgcttcaaaatatgcatacatatatacatataaatgaggccaaggacaaaaactagaaataaatatgtcaaaaggttaacattttaaacctggtgtcattgtataggtgttcaatacacaaagtattcttgcatttttctgtgtgcttgaaatagtgtttaaaaatgaaaagaaaaacaggataagaaaaaaatactaccaaacggtaacaagtgttatccaacaaatttcttgattaagggtgacctatttcttaagttgcacacaagagcacagatatctttttaagactggagaaaaaaacactgtattttaaaaacaacagaattctaagaagacaaatgacttagtatattatagttgtgtttctaacttgaagaaaaaaaattaagtgacatttaatgaactccagagccctatggtatagggacccttttgggtcctactacttcacttttaatttctctgagatttagacacaggaccaaagtttaaatggtatcaatgaaatgatgttaaaaacataaatataattagcaatttgatgacagcaatattactcagttataaaagaaaaaaacactccatgaaaattatttttttaaagaattgtaattttagagagactaaaaatagtctgcatgtcacagatttttatataaaattagcagaagaactggaggttaatttccatggaaaaaatgacccaaaatgtattattactgccatatctattctaagactaaactgtcccagacttgaaacaactttagggcctgaggtgaccagcctttagaatacaggagctgtggcagtcattgatatggctcgagggccacacacacatcccacctgcattaaatcctcgagggacagcagggccaagaactgcctcaccaaagccctcccaaagcttcaattaggtttgatgagcatgtggcagaagacaggtgcctggaaggaaaggaaggaagagagaagagaaagtagaatgggggtagggtgcaggggttgttgagcagggactaaatcaagccaggaacttttcagaaatggttactgaccactagttgtatactgaaatataactgaaattaaaaagaagtataaaatgtcgtgatcaatcatgtttgcagcaagatgtggctagtcaccctggaattaaatataccactggaaaaacaacaacaaagatttccccactgaaatggtaactaaagatttaaaaatactaatggaaaatagggccatttaaaaagtaatatttagtcacactgaaaactctcaaaataatctcatacaataatttttacatctaagccccttgggttcacattttaaaaatcaatttagtgttgaagcaagggggtagaaaaattgagtgtaggaatacaggcatcattacactacacaacacacaagactcacaccaccactcaagcaatgacactggctaagagctaatgtgctgtgaattacacctcccactaccacagcccgtctgtgcagagaataaatcaaccgaatgtgaatgagtattcccttagtactcagtgctttcctcaacttgcagttccagtttcaatagaatctgccattcaaatgcaagagaactactcactttaatagtctataattttttatggttttactcatctagtatgtaggcctgtttttaccaaaaagaatgtttcaatgtaagtaatcaatatttagtgtatggagtatcagtcctattagctaataatggaatcacatcaattgtgcaaaagttagaagatttgtacttgaacaagtggaaagagataaaggtagatgattgttcaactgacaattactcataacatattatgaagaggctaaagccaaatgtaaaaaatacaacagcagatggatgaagccagtaaaaatcaggaagttgggggaaatgatgaaatactttatagagtaacagataatacctcaagggcaaattaggggggagggggaagagcaaagtgaaatacatcatagatttttagtaggaaaaatatgtttaaaaatgaatggaaaaacattcaaaatgtaaaactatattattgcaacatgatggttcagaagttcaaaaattttaggaaaatctcgtttatttttccagaatcaacattgaattcaaggtagaggagaccaagacatgaggaaatcggaagtgacagtgatggcgggacacacatttcatgtattcattttccacagaaaaatttccaccagagaaaagattccatgactggctgcctaagttcaaaccttagctctcataatcacaaatgtgccacccaattaacattaagaccttacagatatttaaaatggccaccagcagagctagcaaagaggattactataatagtcgcatctctcaaattatttatgtccatagaaaaatataatttgatttttaaaagttacacttacatggcacttattgaatagaatggcacctagtgaatgaaaagatatgtacttggaataaattacatacaggttattctagccaattaagcctcagagaacagtatttgctctatcctagcaggaagaaatctctcatttaccaaattgccaggaagctgcaggggcaactgtttcatttaccatggtatcctcaagctttctaaggtgccatctcatctaacctgacaactgtccgtgaggtggtggttatccccattttgttgatcaggatactgaggctcataggaataatttattttttccatatctattatttgatatactacatatttatagcacatcatttattttgattattcttcttccttgattagaatataataatcatgttatagcatatttacttgtctacagttatatctctggtgcttagaatagtgcctggcacacaggacatttaataaatacttgtttagtgattaataacacaacctgcctaaaattatttaatgtatatccaataagcgagagacctggggtccaattcaggtgtctatctttaaggccatgttcccccaaactggaaagataatgattacagcagaattaaaatatgaaaagtaaaaaggaacaataaattagaattagagttttaaaagtgccttataggtaaaaactgtgaaacattttaaaaaatatttttctcctgaacatttccttgaatcttctcttgcttataggtctggtgtattgatagagttcgaccagcagaggtgtgcaggctcctgctttataggcatgttcaacaaggctcccaggcagcacacaacagagggttggtggcccatgaaccagggatcaagggaagccctgagtagcccccattcccacggaggctgggaaaagtctgcagtacagtgaaagtgctgtccaggttaaaacaaaaacaaaacctcacagactgcaggagtagccagggtctaccctacagccaaggagtgttacatggaaatgaggacctgcatgggcccagcttgcagcatatggccctgtgcccttccggtggtctgtggcagctgatcctttaaaatagtcaacttccatacaattccctaaaattatatcttcttttttttttttttttttttttttgagacggagtctcgctctgttgcctaggctggagtgcagtggcgcggtctcagctctccacatcccgggttcaagcgattctcccgattcaagcgattcaagcctcagcctcccgaatagctgggattacaggcgcctgccatcacgcctggctaactttttgtcttttcagtagagatggggtttcacaaagttggccaggctgaactcctgacctcgtgatctgctcgcctcggcctcccaaagtgctgagattacaggcgtgagccactgcacctagcctcctaaaattatatcttttagggaaggaggagcttacgcttttcttcgttcttttctgaacaccatgggttctttccttgatgttgggcagaatgtgaatttctcatgagaaatagctgactgaatggctaatcaaaagaaataatttatatacattatatgtttttatttccaggaacatactaaagtaagacaagatatctgtatttgaaacctaacaacctatagattttaactggctttttgttcccatcttaatggctatatgttgtcctaattaatattaaaacaattaatttttaaaaggtaaaaaagagtaaaggacaacactatagctataaaggactaggaaatgttgaaaatgttatggtcatcaccggacttcatctcaggatgccatcccccaccccccacacagttttccttcctgaaaagttgccaggcatgagctgaaaatgatagcctttatttcactaaaaaagtaataggagataagtcatcgatcccctcctacaccccaaataagacaatggaatttctggatatctatcggcctatcttttcgactgactttttttggggttaaggtgatgggcaacaggagtggcagagtagagagtatgctaatgtttttatagcatatactatgagctatgcactttcacatgcacacaacaactctgaagaaggtactgtggtcatctccatcttataggtgaggcttagagacaggttagcgtcttggccaatgtcaaaagcaagtgaaagaatcagaattcaaaatcaggacaacttgactccaaagctgctaccttagttactaagttatttgttgaagttctttggttcccaggaaccaataatgttgagtcattgctattactccaatgtgaaagggctgatggaactcaggagtgaaacaaacagggtaagttttgtttattattggtacaggctaaaaagcctttaaataatcactggaatattaaacttaaatcaaacagctatggttaatagttttaaacccaaataaaaaaattaatatctacatttatttcaatgtgttgacctgtagcacaatgttcacttcatgtttctaaactgaaatgtttccatcagtacaaaggccatattataacaacagacaaataataaatagtccaagcttctaaatactgctaatggatacaccagcgactcaatgttggccactttatcccagaaaggtaaaagtatcaaactcaaatgacataatagcgaatatctattgcaggcagtgctcttagcatttttttttaacttacttaaacttcacacaagcttgtacagtactactgttatcctaattttacagatggggaaactgagacacaaggaagtaataagtggtagagccatgattttaacccagggattaggattctagaaccttcagctattctcatccttcctttttgtaaacaatctcaaacttatagaaaagttacaagtacaaagaattcttcttttcctgaggcatttaagagtcagttcctatcttggtacctcataaccatgggatactttagggtatataaattacaaataaggccgggtgcagtggctcacgcctgtaattccagcgctttgggaggccaaggcaggcggatcacgaggtcaggagatcgagactatcctggctaacacggtgaaaccccgtctctactaaaaatacaaaaaaattagctgggcgtggtggcgggcgcctgtagtcccagctactcgtgaggctgaggcaggagaatggcgtgaacctgggaggcggagctcgtagtgagccgagatcgcgccactgcactccagcctgggcgacagagcaagactccatctcaaaaaaaaaaattacaaataagaacattcccctaggctgggcatggtggctcatgcctgtaatcccagcactttgggaggccgaggcggatggatcacctgaggtcaggagttcgagatcagcctggccaacatgatgaaaccctgtctctgctaaaaacacaaaaattagctgggcctggtggcagacacctgtaatcccagctactagggaggctgaggcaggagaaaagcttgaacccgggaggaggaggttgtagtgagccgagatcgtgccattgcactccagcctgggtgacaagagtgaaactcagcctcaaaaacaaacaaacaaacaaacaaacaaaagaacattcccctaataaccacaatacaaccatcaaaatcactaacgggaatacattactaccatctaattttcagatccaattcaagtttcaccaattattccaataatgtcctttataacaaaaggatccagttcagaatcatacattgcatttagttgccatgcctcttcggcttcctttaatctggaaccgtttcttaactattccctgactttcatggcctttacaatttcgaaaattacaggccagttattttgtagaagttctctcagtgtggattttgatgtttctctgtgattagattgaggttttacatctcaggcgggaagatcatagatagaaacaatgttgtattcttcccacctcaatttcagtttgttccatgacagcagatttccactttggccgtctgagtaaggtgatgtctaccagccttctccacagcaaagttacactttccccctttataattagtaatgttttgtgaagaggtactttgaaactatataaatatctcattcatcacacaccagagcaggaaaaacgttggtgggtacttacaatgagttgcctctcttgatccaatatggcatcattagctcaataaaaacaaaacaaatcaaaaaataaattgagaagataaaaatgtatttctgtagagacaatgtaaattttcttaaatgaataaatataaagagaacttatgaagtttagctgataagcaaatgattcaacagtgaaagtttcaggccaggtttagtggctcattactataatctcagcactttgggaggctgagggagaaggccaggatttggagactagcctgggcaaaatagtgagatctcatctctacaaaaataaaaataaatgtgaaaattagctgggcatggtggcacatgcctgtcatcccaactactagggaggctgagatgcgaggactgcttgagcccaggagttccaggatgcagtgagctatgatcacaccactgtgctccagcctgggtgaacagagcaggaccctgtctcaaaaaaaaaagtaaacaaacagggaaagtttcaatatttcagacagtcattatcttttccctgggggaaaaaaaaacaaaacagttccacatttagtgaaataataaaggccacaaatacagattttgctttaaatggtggcttttaaaaagatgatgcaaaataaataaggtcttggattaagcaaagggggagaaactaggaattatacacaaattaatttaaataaagtcaaaaattgtttccaccacattaaaagtaaaaaaaaaaattgataaaagtaatgggaaaaaagtaattactctcttcacattgccaatatagttccaaacattatgaagttgaggacaatgataaaagatgaaacctttgtctctgagcacatctgtccaaaaggtaatgaatttcagatatgaataacagatatttgtatgcccaaatgtagaaaatgacttctcttggtataaagttctaagatggttttgttaacaaatacagctgtattgtttgtatcatcttgatatcaaaagttctgctcttccccaagagtagccagaccaatactaaatttaaggatcaggtgaatatttaatatttcaggattattttgtttttattatttgtgtatgggtagaaactagcaaattatcaacagattatttaagcctatcaagatgcttgactatttagaatatggtcctcatcttcaaatattctttacttaaatcaatgccttgtgaatggttctaacttgcatattactcaagagctgaaaagttctctataatatataagcacaatcgccactatatacactggtttccactcagtctggtttcaaatactgtgatataaatactgtgcaagctactgcctacataaaaaatagttaaaatttcagtgtaattattttacacaattatttaagtagatctgaaaggtctaatattctcatatttccaaaaaagctattattctctatatctgcattcttccaaaatgttcttttaactaatcatatagtgagatccagtaatttcctaccaaatagcattaacacagccacatattgatatacgtttctgaaacaatctatcagatgatggaaaaatattctcatatttttgtgaaattttaggaaaatgagctaataagactttttgataaagaaacttcatgaacagaaacttaactttattgattcagagacctgaattttacaatatcacagttttaaaatgttgctaagaaatgtatttagtattgaagtaaaccatcataagaaaatttcccaagaatacgtcatgtttttcaaaaagaacagaagattaaccataactgttaagttagtattgctattatgagtttatctttaaaatattctttaactttataaggatggaccatgactgactatctgctaatgtttcaatataacagaaaaaggttcacacaaacttaactatgctaaatattcctacacaagtcagcaataggaaaaacagaataagctgagtttggcatttatggatgaatacatgcaaagaatatggacttcctcccattttttatatactaaactcagtagaagattctaaaattctattaaaaattctcttttatgaatatgtaattttagtacaacttaattaccccatttgtttcattatgctgcaaaatagttttcaaactcctggatataagagggctttcacaatacataggttcaccttttgatataccagtaactgaacaaagctggagagggtagttggtattcaaaaacatggtggtaggggagacagcatgtgaacagcaagaggtgatgtacaaactatttctaccagaaaaaaaattaaactggctggttcatatagagaagtggttcttaactcgggtgattttacctttctcctttcccacgaggggactttggcaatgtcaaaagagatatttttggttgccacaccttgggggtggaggggtactagtgccatctagaaggcagaggccagggttgcttttgaacatcttataacatacctgataggcctccccctccctcacaaagtgccaaggttgagaaactctgatttagagaatccatgtgtacttatgagacttgccccataggattataataaagcctaaatataaacatttagcttataaaacgctaactatactccttgtcacaaactatgtgctcaatatgcactagttattactattatcagaattactattgttatccatatagtcaatgctttttggcttcagtgaaagctggaacagatgcaatcctatgtcatctgccccactgtaaatacatcaagaataacttttaagacactgaaaaaaaaagattttttaaaagactatggcaaaaagctttttgaatgtctatacagacaccaggtttgtataaacaacacatgtggatgtacacaatcattttagattaggaaaaatttattctagattaataagaataacaataaagcatatattttacttctttcttccctaggcaacactcccaggaatagcaactgattttatttacagttattacaacaaagtattttttaatagccatgctttaaaaagtcataaccattctatttaaagcttaaagccaattactctccttctgtaatttttctcatattagctaatatgacagcaataactaagcatggtaagccattggaactacattacaactgcctttgctccccagatctcatgtaattatatgttacctcttcagccttcttttgcttgttacatcaataaaaagtttttctgaagaagcaaagtctttacttacaaaaagataggtggcacccctcaatatgatagcattaacactttcttcccagttctcgaaagtgccaaagattctcaaattaagaacttctcaattaaattcatgaaatcctgaggcaaaatatcagcttagatataaatgaattttaacagagtaatgccttttagaaaatcactggaaaatttaaaatgtatttttctattctttttctcagggaaaagcttatgattttaaaaggttggagaatttaagcaaacactcagtagttttggaaatgtagtttccatggcaaccaacatggtcttctttatatagcattataaacagatggtaaagagtggtcatgtttgtttctctgccagtatatcaataaaactactatcgtactgtattgaatacacttgaactatttaatgaatttaatatactaaccacaagatgtactaatttagactgatgtaatgaattttttttttcttttaaataaacacatgaagatcttgaacagtgaagtcactatactccatatactcaatagtctaccttggcaagactttgtacaaatgttttctcagcacttgccatgcagggcatataaccacaaatattaatctgacaaggagaacataatagattgaaataataaaagtgaaaccatgtctgtaattatattcctttgccatcttttcttaaagaacaaatgagaaattatgaaacaggaagagtttctttacaataaatgataggatataaagcaaagggcaaaattgctgtttaaaaatcagactccattccatgtacacagcggcagctttcagaaatacaggtactctgaattccactgttttaactgtggtaacttgctgggtactatttgcttaaaaactaaaagaagccaagaaactataaatgtgattagtctggcagtgaagtctgaagagccaattcctgcatgtattatcagcacatgtgaagcagcgaccctgtatctggaagaaagtcagtcagtcagaaggggctgtacagtaggctggggctccccagggaaaactggcagtctttttcacaggctcgtcttagagaccttgatctattttccaagctagcttgaggatccttaccttaaaaaaagctgggtcaatatttatgattttaaattatataaatagccatttttattatacctgcaaaataatatttggtaaatggtatctgtcctacattctcccttttataaagtcctgttttcatgcacccatccctaaatttgctaatttttagcacttttttctatttttttttttgagacgcagttccactctgtcaccaggctggatggagtgtgatggcatgatttcggctcactgcaacctccgcctcctgggttcaagcaattctcctgcctcagcctccccagtagctgggactacaggcatgcgccaccacgcccagctaatttttgtatttttagtagagacagggtttcaccatggtctcgatctcttgaccttgtgatctgcccacctcagcctcccaaagtgctgggattacaggtgtgagccatcacgcccggccctttctatgcttcttacatcaaagtaagttaattagaagtgagatacttcattgtgtgtaacaatccatgatggaaatacagaaaatgggtatgcatatttttaaaaggtgtgaatttgggtgatgtacagtatatatggtttaattgaaaaacaaaaattttcaattgaaacattttaaaactggcaaagactgtactagatttatatttgactcaaaaatgggaaaatgtctgctacattatgtatcttagataaactactgtcaattctggcctaccagaaattgctaccataatacaatttttgaaaattatttaaacctagaaaatagtctttctcatagaggtgagagtctccaatcaagctcaccaccccaaaaaagaatacctgagtgattccacaaccagaagcccttttcagagggttttcagtttgtcttcttctatagtacttgcagcgtggaaaaccatctagaaactgatagctcttagtttaacttaacttttttcagaggtacctgtgtaagagagattctcagtcctggctgcaaaacagaattacttgaagagctttaaatataacaatagtcatatcccagcatatgccaatttaggcaggatttctgggagcggggccacaacacccttcacgtgtgattctaatgtgcagccagggtttaaagaaaacaccagagagactgtgacttgtttctctttatccctgatgaggaagagatctcaagtcaccactttgatgtctacaggacacacaattcagtgttagatttcctcttcattatagagaggcacaaggctgaagaaaaaggcactattatactccattatttggtatagtaaattttattggaaaggagttcaacaaaataccagactgaggtatgaaaaaactttccccatgaactattccaaataatatttagcttttggccagattaccattattagaaagacttgtgaacagtgaatttactttcactccttttgggaagccctcagtgtttgagctggttatgatgtattctccacattgaacaaaataaatgctttctgggtttccagtgtacttagacattctgaagaacggactgaaataattagcattgtaattctcacattatttcatggacatcatactctcttttacaaaaatgaccttaaaacctatcaccaacagtaatgaaaattcaggtgtttggagaaggagaagctccagaggtaaggaaaacaccttccaccttttttctgtagcacacatccaaaaatgttaaaaacctgttaatatactgtctcctaaaaagaataaaaatgaatgtcatagatcataaatgttatttcaagccacaaacatttcttatttgactacatgtctatctggtagattgtggtaatagttctttatctatatggttttctcctttcaaattatttgcaagatcaatgacttatttgcttgatatgaaatagtaaagagaaataaaataataaactctccaaactgtcagtgatataaaacattaagagggtagagttaaataatctcagaaaataaaccatgacaataccagagtcttaaaattggtttccacatttttggtttgttttcttacatttctacaggctactaaaatttccgcaagtcatttattctttccttgagaaactttatttggctatttgtgtgtctggtgctattaactcatcataattttacatcaatcctcataacatgattgaggtttaattctaaaaaaattcagaacacacaaaacaggaaaaaatatcactctaatgcattttggaacaaacagcctattaaagagaataagtgtgtctggcagaattctagagatgacagaaaacgaggaaacaacatttcttaatgttatttaaatatgcgcacaggagacagggagatgtgctaggacacagcatcacaggaactctagtcttcctgcacataaaatagggcttcattaacaataaaggaacaggtgtcttgggacccatttatacaggctattaactattatgagctgctggtatccaaatttattttagtactaggcaactgattaaaaataaatacaaatttaaattccatctattagcatgagaaagcaatgcctagatttccagagtctaatttaatataaaggtatttttctatggtcctaatcacaggaggatacttaagttcatatacagtattttctaaatctcaaaataaaagctttcctattaaactttatttgaatgtaaaaaaaaattgatgaatgaccttttatcttgacctgacaataccaaacaagctttatttactaagaactaaatttttattcaaatgtaaacaaataatgacacaaacatgcatccattttttaaaaagtaggggaggaaatcaaacataccaacctccagctctaaattcagtgcattccaccacattttatactacttattttgaaaaactgagtggcaaccgttattctctggcaattttttactgtttcatctataaacaatgataaagaatttaaaattttgaactatttgaggaatctttacattttattaaaagatatttaaaatgctagagttggaactgcagtagtgataatcttgtccatcacacttttttacagaacaagaaaataaggcacaatgaggctaagtaatttagccaaggtaaacatagcaatattttaaccacataaattgtcaaaatactattacactataaaatcagtataatactggttgagcatccctaatctgaaaattcaaaatccaaaatgtttcgcaatccaaaaatttttgagtgctaaaataatgccataagtggaatattctatacctgacctcatgtgacaggttgcagtcaaaatgcagtaaaaaatttgtttcatgcataaaattattaaaaatactatgtgaaattaccttcggactaggtgtataaggaaacaaatgaatttcatgtttagacttgggtcacattcccaagatatctcattatatatatgcaaatattgcaaaactcaaaaaaatccaaaatccaaaacatgtccggtgccaagcattttggataagggatactcaacctgtagtacgtatcttccaagtatgttctgaaaattaaacagggtaacctatttttgatgttatttcaaactgctatattcatctatgtctagttaaaaacaatttttggtttattcacttacataatgttcttatagtgatattttttccacttattccagaagtgttaggtgattattctacacttcttgtgccacattctatggagaataaagatggtacaacatttgatctatatccataagtagccagtaaaagccattgcagaaatgatgaaaaatttgagactgaggagaaagccatggatagaatcataattcttaaaaatatggcaacattttaaatgaaaataataaggccagggtttctcaatcttggcactaatggcattttgaactggaactttgttgggaggggctgcgcattacaggcattatatttagtagcatccctaacctttacccactagatgccaatagcacccccagttgtaatagccaaaaatgtctctagatattggcaaatgtccccaggagggcaaaactgcctttggttgaaaaaaatcacaggataaggcagactactatcttttgattttcaaactgtgatacatgcttaatatcatctagaggcaaagcaaatcaggagctttagcattctcgctctttttttttttttttttttttgagatgagttttgctcctgttgcccaggctggagtgcagtggcgtgatatcagctcactgcaacctcagcctcccaggttcaagtgattctcctgcctcagtctcctgagtagctgggattacaggtgcacgccatcacgcccagctgattttttgtatttttagtagagacagggcttcatcatgttggccaggctggtctcaaactcctgacctcaggtgattcacctgcctcagcctcacaaagtgctgggattacgggcatgagccgccgcacccagccagtattctcttaaagattacttcagatctagccaggagcagtgtctcatgcctgtaatgccagcactttgggaagctgaggcgggtggatcacttgaggccaggagttcgagaccagccttgccaacatggtgaaaccccatctttactaaaaatacaaaaaattagctgggcatggaggcacacacctgtaatcccagctacttggaaggctgaggcatgagaattgcttgggcccgggaagcggaggttgcagtgacctgagattgtgccactacactccagcctgggtgacagagcaaaagaatgtgtttaaaaaaaaaaaaaaaagggagagagagagagagataacttcagatataaggcatcaagcattaaaatacctgagtatagaaataaaatcacatattcaatatcaaggtatggctttggttttgattttgtggttttctgccactaacttctgaaaagtccaaagaaatatgaaaagtcctggaggcggggggcggtccttgatcctgaggagagatggggatctttcatattaaggtttctcaaattagaaattgctctccctcttgcccaagaaacccttagtacatcctttcctattctttcaaaatataacatgtcattttgttgacacataaattgcaatcaagtacaattccaggctggtgtccagaagctagccattcagtccatgtttcacccatccagtgacctaggagcattaaaactatatggttttgttttgttcttggtatataaattttgtgggcaaagaattgtcataaaaccacctcaaatttcacactttccaaagatctcaagaattgtgaaggtttattatactggagattgctaaaatgttagatcaaggcgcaaataattgaggtggcaagcaaatattaggtctacaaaatatatgaagaggaagagctgacctcctctgtctcatgcatcttcctgtgtattctctcttctctagccttcacacctgctgaagtataaactgaacaactgcttggtaatagcagtacctcattaaaaatgtggtgcatagagtctgtggaagtactctagaaaaaggcactaagagagaaaagatggaaaggaatatttgagaattagtgaccaaatgtgagttggcttgggatcaaatttaaaaagaagtaggcccaccagaggcatagtttatgagataggcttgccattagaaccttctctgcttctagaagcctacaagctctgcattaaaaaccaacaaaaaacatctggataactgatgaatttcgaaatcataatcactaagaggacagtgttgctcattttggttttgccttcacttgaaaagttaccaagtggtctcaatttctcatactcaacaaacttttgtttcttcaacattgtgaaagaagagagcggtctgtgttttcacaaagggatgcctacaggctgaaaagttctgttattactgttttgttttgactctatgtatagtgatatctccaacattagaaatttggacataatttgctaaatctgaatttacatactgggcagtatttcctttaacaaagtctaattggaacagcattttatggtacatgaaaatttaattgcaaatgttagagatacagagaagtctgatttatatagaagacagcttatttttagttggaaaaaactgcaatgccaaactattttgcatttaatgctataatttacatatattataatattcatgatatatgataaatacccaaatcctatttggaaaaccttcattgtgaaaaaaattagaattttaacaaaatggtgtctcatattttaaagactgttctcatttttaaaaagtaaacataccaatttgataaaagatattaaatctattactaataaattcaggttcttgtggtatttcttgaattctaaatattgaaggtaaacaccagatatatgccaataaatttctaaatttataaaatcagcaccctgcattttaagtacatacttcagacatttcacacaggtacagggttaatttaacaaaggattatttcattataacaggcaacgtgctgccacaaactacagaggaagagagctctgaaataattgatgctctctgacccatttcatttttcaatttgtgtttcaaggaaaacttcagggttgacattttctacttgaccctacaaatgtcttttctctccacttgggcaaaaaaatcatccatatttttacacaattaaactacgcccctaccacccctgccctaaaagactaccaattaaggccatcattactcaacataaaacataggatcacacatgtaacactatccaaatcactggtgctttaaaatgtacagatagagacttccatttatcatgatggaatgaggtggttgacaaatcctccctcaaaatgcaactataaagctgaacaaaatagtcaaaagcagtaatttgagcactctgcaatccaaccacttcattagaactgctgaacttcagagaagaacaatatgagtttaagacatccttgccagcagctgctctcacctccatccccttgctttatcagcacagtagctgaatcagtgcagggtaggctgtgaaaacaagcagttttgtttcaaagctttgtcacccctgccagaggaggctcacttgattttgaagactgcacttgattttgaggactgttagttaaaagtactgatggcctgtggcatcacaagcctgaataagcaaacctgacgggggcaggcagcagacaaactagccaaatatttaacagggaattccagcaaccacagggagcttgaccccacatatttacggttgaccaggctgtgtgcattgccacagagaccagagagggcccatatatccctggctgatggagcctgcaggcatgtgcaggtgggacatgagaggtcccaaaaggaaataaaacccagagcagcctgaagtttgaatgtgctccgaagctcacacacagatccatcaggagagactggaagtctcactgtcttaaggtgtttcagcgtaacttctgaccagtctttggttgatcactaagctatgcagacacaaggacaacaactaggaagccagacttacaaataaaaggaagggataaaatagtgagaagagacgtcacaactgcacattgtgaaggatacagacttcaaaggtttagtccaggcaagtaataaaactaacaacaaccaaggtcaccaacagaagggaaaagtgagaaactagagttgctacaatatattgtctaaaatattcagtattcaacagaaagttaggagtcatgcaagaaaccagaacatatgatccatacaaaagcagtcattagaaactatctctaagtgtctttaagatattataagcaaagggttcaaaacagctattataaatatgctcaaaaaactaaaaaccatatttaaagaattagtaaatgactcagtgaatacagagtctcagtaaaaagatagaaaatatttttaaagaaatcaaatggaaattctggagatgaaaagtttaataactgaaatgaaaatatcaccagagagtgcaatagaggatgtgaaatagcagaaaaagaagcaataacttggagatagatcaatagtaattatttaacctgaataacataggggaaaaaactgaagaaaaatgaacaaagcttcagagaactaccagacaatatcaagcatactaataaaggtgtcattaagagtatcagaagatgaggaaaagtgagaaaggggcacagaaaatacttgaaaaaataatgggcaaagacttaccaaatttgatgaaaactgttaatttacagaacaaagccattcaactaactcaatacaggacaaatacagagatatacacatagacacatcagagacaaactgttgaaggataaattgtgttcggaattggtgggttcttggtctcactgacttcaagaatgaagccgcagaccctcgcggtgagtcttacagctcttaaggtggcgcgtctggagtctgtcccttctgatgttcagatgtgtttggaatttcttccttctggtgggttcgtggtctcactggctcaggagtgaagctgcagaccttcgcggtgagtgttacagctcttaaggcagcacgtctggagttgttcgttccatcccggtgggctcgtggtctcgctggcttcaggagtgaagctgcacatcttcgcagtgagtgttacagctcataaaagcagcgtggacccaaagagtgagcagtagcaagagttattgcaaagagcgaaagaacaaagctcccacggtgtggaaggggacccgagcgggttgccaatactggctcgggcagcctgcttttattctcttatctggccccacccacatcctgctgattggtagagccgagtggcctgttttgtcagggcgctgattggtgcgtttacaatccctgagctagatacaaaggttctccacgtccacatcagattagttaagatacagagttttgacacacaggttctccaagtccccaccagagcagctagatacacagtgtcgattggtgcactcacaaaccttgagctaaacacagggtgctgattggtgtgtttacaatccttgagctagatacagagtgccgattggtgtatttgcaatccctgagctagacataaaggttctccacgtcctcaccagagcagctagatacagagcgtcgactggtgcactcacaaaccttgagctaaacacagggtgctgagtggtgtatttacaatccctgagctagatataaagactctccacgtccccaccagactcaggagcccagctggcttcacctagtggatcccgcactggggctgcaggtggagctgcctgccagtcctgcgccgtgcgctcgcattcctcagcccttgggtggtcgatgggactgggcgccgtggagtagggagtggtgctggtcggggaggttcgggccgcacaggagcccatggagtgggtgggaggctcaggcatggcgggctgcaggtccccagccctgccccgcgggaaggcagctaaggcccggcgagaaatcgagcacagcgccagtgggccggcactgctgggggactcagtacaccctccgcagccactggcccgggtgctaagtcccccattgcccggggccagcagggctggctggctgctccgagtgcggggcccaccaagcccacgcccacccggaactccagctggcccgcaagcgctgcacgcagtcccggttcccgctggtgcctctccctccacacctccctgcaagctgagggagtgggctccagccttggccagcccagaaaggggctcccacagtgcagtgggggggctgaagggctcctcaaatgccaccaaagtgggagcccaggcaggggaggtgccgagaacaagcgagggctctgaggactgccagcatgctgtcacctctcaaaatcctgaaagtagcaagagaaaaatgactttatcatgtacacaggaataacaatacaattaatggtttatttctcatcagaaaccatggagaccagagagcagtgaaatcaatgatacacttaaagtcctgggggaggcggggaaggcttggcagctaagcctttgtataccctgcaaaactttccttcaaaaataaaagtgaaataaagataatggaagtgatattagacagtaatctgaatctacatgaagaaacaaagagtgtaaaaaatagtgaataggtgggtaaatgtaaaaaaaatctgtaaatacatttttctcatttcttctcttaaattttataaaagatatgattacataaagcaaaaattataatggacttataatatatagaaatatatttaacaatagtaacacaaatgaaaaatagagatatattggagcaaagtttctgtattttgctagaattaaaatgggtattattctgaagcagactgtgataaattaagatgcatattttagcccccaaaacaactaggaaaataactcaaaatcatacagctaaaaaaaacacaaattgaaatcattccctaaaatattttcatttaatacaaaggaaaggagtaaaggaggaacagagaaacaaaaataacatgagaaaaaatacaaaataattagcaaaatcagacttacatcaaaccatatcaataattagatcagatatgaatggacaaaacaacccacttaaaaagcagggctatccctgcttttaactggatttaaaaagcaagacctaactacatgctttctccaaaaggcacactttatagaaaaagacggtaataggttaaaagtaaaaggtcagaaggtgatatgccatgcaaacagtcaccacaatagagctggaatggctatattaatgtcagactaaatagacacttagataagaaatattactggagacaatgaaggacatttcataatcataaaggtttatcatagttttcataatcatcagtatatcataaagatataaaagttttaaatgtatatatacctaacaatagagaccccaaatgaaacaaaaactgaaaaaactgaaagaagaaacaggcaattcaggaaaaatagttggagaattcaataatactctgctttcaataattaataggacaactacacagaaactcagcaacaatatagaagactttaacaacactatcaaccaacttgatataactgacatttatagaatactccacacaatgagtgcagaatatgtattcttttcaagcacacgtggaacattctcatatgctgggccagaaaacaagtctaatacattttaaaagactgaaatcataaaaagtatgttctctgaccacaacacaagttaaagatctcaaatagaaagaaataggggaaaacccaaatattttgaattaaacaacatacttctaaatagcccaggggtcaaagacgaaatcatttaaaaaattttaaaaatatttccacctgaatgaaaatgaaaagacaacatatcaaaatttgtagtgtacaactacaggagtacttagaggaaaagttatagcatattctgaggaaaagtgtcaaataaataatctaagcttccatgttaagaaactagataaagagcaaactaaccccaagcaagcagaaaaaaagaaaataataaagtttacagtgaatatcaataaaacagaaaaaagaaaaacaataaagaaacaaatcaatgaaaccataaagtgactatttgaccaagaaaataagaaagaagacacaaataaacaaactcaggaatgaaaaaagatcacattactgaccctataggaattaaaaggactatgagggaatataatgaacattactctatgccaacaaaccagatgacttagataaaatggacaaattcctagagagtcagacatttccgaaacttaagaacacacagaaaatatgaataggactatttatatttaatataaataaatacatttataagtaaataaattgaattattaattaaagtcctttccacaaggaaaggcccaggcgcagatggttttgcttgcaaattctatattttagaaagaaatactgattcttcacaaacttagaaaatatagaaacttcccacctcattctctgaggtcagtacttaccctaacaccaaagccagacaaagacatcataagaaatgaaaatgacagattaatatctctcatgaatgcagacacaaaagtgctcaacaaaatattggcaaactgaatctagcaatataaaaagaggctcatataccacgactaagtgggattcatcccagggatgcaaaatcaagtaatgtcaaagcacgatgtaggctgacttttaagatcaagtatttaatatccatattaataaataaaggacaaaaaacacatgaccatctcaacagatgcagaaaagcatttaataaaatacaacacctattcacaataaaaactctcaatatgtgagaaacagaaggaaacttcctcaacctaataaaagatatcagtgaaaaacctaccactaacataaaatgaaagactgaatgaatgcctcccacttaggactgggaacaaggtaaggatgtcagttcaactcaatgttgtaccgaaagtttcagccagtgaaataaaaaaatttaggccgggcacagtggctcacgcctgtaatctcagcactttgggaggctgaggcaggtggatcacttcaggtcaggagttctagatgagcctagccaacatggcaaaaccccttctctactaaaaatacaaaaaaattagccaggtgcggtggcgggcaagtgtaatcccagctactcaggaggctgaagcagaagaatcgcttgaacccgggaggcggaggttgcagtgagctggaggttgcagtgagctgagatggtgccactgcactccagcctgggcaatagagtggaactctgtctcaaaaaaaaaaaaaaaaaaaattaaagacatccagatagtaaaaggaaggagaaaaactgtatttgagggtgatcatctatgtggaaaatactaaggcatctataataaaaaatactagaattaatacatgaatttagcaagatctcaggatatatgattgatatattaaaaaactattgtatttcaggccaagcgcggtggctcacgcccgtaatcccagcactttgggaggtcaaggagggcggatcatgaggtcaagagatggagaccatcttggccaacatggtgaaaccctgtctctactaaaaatacaaaaattagctgggtgtagtggtttgcgcctatagtcccagctactcaggaggctgaggcaggagaatcacttgaacccaggaggcagaagttgcagtgagacaagatcaggacactgcactccagcctggtgacagagcgagactcgtctcaaaaaaaaaaaaaaaaactattgtatttctatatatcagcaacaaataatcaaaaaatcaattcacaataacatcataaagaataaaatgctcaggaataaacttaaaagaagtgtaaaattcgatgctgaaaaccgcaaaactttactgagataaagaagatctaaataaactgaaagacatttcatttttacaggttggaagactcagtattgttaagatgtcagttctccacaattgatatataaattcagcacaatccctatcaaaatcccagaagacttttaacagaaattgataatgtgggccagtcacggcagctcacacttgtaatcccaccactttgggagggcaaggcgggaggattgtttgagcttgggagttcaagactagcctgggcaacatagcaagaccccattctctacaaaaaacataccaggcatcacaggcacacacctgtggtcccaggaggctgcagtgagatgtgaccatgtcactgcaactccagcctggacaacactctccctctctcaaaaaaagaaattgataaggtgattataaatttaagtaaaaatgcaaagtgcctagaataggcaacactaccttgaaaacaaagaacaaaattagaggacttgtactactacctgaacttacgataaagctacagtaattgaagtagtgtagtattggtataatgataggcatagagatcaatggaacagggttttcagtacagaaataaatccttacatttatggtcaattaatttttgaaaaaagtgccaagacaattcaatgggaaaaagggtcatatcaaccaatggtgctggggcaactgaatattcatatatttatttttaaaacacagaacaggccgggcaaagtggctcacgcctgtaatcctagcactttgggaggccaaggttggcagatcacgaggtcaggagttcgagactagcctggccaacatggtgaaactccacctctactaaaaatacaaaaattagccaggcatggtggcgtgcgcctgtaatcccagctactcaggaggctgaggcaggggaattgcttgaacccaggaggtggaatttgcagtgagctgagattgcaacattgccctccagcctgggcaacagagtgagactccatctcaaaaaataataataaaataaaaaactaaaaaagaaaaaagaacaatgtagactcttatctcacatcatataaaaaattaacttaaatcaatcatagtccttagagctgaaattataaatcctctagaaaaaaccataggagcatatcttcatgacctttctcaacctcaccattacagagaattctttgttgtaaaggattgtcctatccacaaaaggacgtttaactgcatccctggctggctcctactcactaggtgccagtaccaatctccatacacagctgtgaaaataaaaaatcatctcaggccaggtgcagtggctccacctgtaataccagaactttgggaggccaaggcagaagaatcacttgagcccaggagtttgagaccagcctgggcaccatagtgagactctgtctctacaaataaaaaaattagctggatgtgggtggtgttatgtctgtagtcccagttacttgggaggctgaggtgagaggatcactcgagcccaggaggtcagggctgcagtttcttttgtatctcactccagcttggatgacagagtaagatgtgtttcgcaaagaaaaaaaaaaaactacagaaagaaacctaaaagaccttcgccatgagaaacagttttcccaactctgaaaaatgaacaacagccttgaacttctgagttgtggaaccccaaaagagatgaagtgataaaagagcaaaagagacctttgagaatatcacctcacttctagtagttagagttctggattatgctcaagagttttggcaggtttgctaacactttaccgaatcatcattcaggagttttagcacaaactactcgcaaggtctcgagtaattcagagaatattcaccagtcattattaggatatgtttcagtgaaagcatcagcaactcttcattgaatcatttacgcaagattaccttcaaaagtgatcccaatttgaagaaaaaaagaacatgcaacaatctaaatacactaccagattgtgacttctacaaagaatttcaccaaacaaagcttcttgatctgcagtttccattgtattcaataacatcagcaaaattaaagaatctgcaaaaatagtgtggtatggtttacaatgctgaattttaagcctgctatttaagcataacgagtgtatttcaaagataaggaagtgcatattaaagaataatgaaattttaatttctccctctctagttacaatgcaggatattcaagtatcaattttattcttttcccatttagcagacatcaattctagacctacacataacaactcaagaataatttatttttatcacctcttttcaagtggcagaaagtaagatagttcttgatgatgctcagaatatctggttacctctgagcatccagtctccagttcaaaataagaactatcctccttttttatcttttaaaatacagataaagtgaatgcttccagaaaatgtcaaccggccaggagcagtggcttacgcctgtaaccccagcactttgggaggctgaggcgggcagatcacgaggtcagaagtttaagaccagcctgaccgacatggtgaaaccccgtctctactaaaaatacaaaaattagccgggcttggtgggcacctgtaagcccagctactcaggaggctgaggcaggagaatcgcttgaacccaggaggtagaggttggagtgagccaagatcacaccactgctctccagcctgggcgacaagagcaaaactctgtctcaaagtaaaaaaaaaaaaaagtcaaccactggaagccaaagtaccaaaatatgagctattactgtaaaacatcattaagaaaggtctgtttgtaagttaccatagttattcaactcaaagaagtggacaaacttcttttcaccaaaggattggggtactcgaaattcaggtgtatgggaaaaggaaattgaatattttagattttcattctaactcccatataagaagaaatctaagactaaactgaatacagcaagagtaaaggacagtctcaagtggcaacttgagactatctgcaggttacattctcctgttttcatttatttcaactgacattttcccttacaatctactaaacaatgattgtagttcatttttcaaagtaaatgttaaatgcttcctggcatgttgaattaggtcacttcagagtgaaaatactctggtggaatataaaattgacaactataacattagtaagaattagtaagaatgaaggcagacagacagctccaagaccaagaaaaacctagctgggtcttaaagcattgtcgagtctaggacaccttagatgccagttccttgaattaatttacaaattaactaaattaaataatttgtcaaaggctgtaacaagaagggaaaaggcctaatagctgttgagttcctattctaatgctggcatgtgctaggaatatgtattatctcatgtaatctttataatcaccctgaaagaggatatttttcccaacttacaggtaaagaatctgatattcagaagagttaagtaacttacttatagttgaaccaaggcaaaattcaaaccaagaaactagactcttgttttttcttttatatctcagtgtaaccattttacacaatagagattttaggcttttaaaagattcaattaaggagaaagtaataaccatttattatttcctgatgttatggacttctattctagcaggcagtcaaggggggtagtcaccaaactgtgggctggaagcaaggtacccaggcaaagattttagcaggtaccagttttctttatttttttttcaccctggtttttggtttctctctcactgttgtacaccggtagtttaaaaaatcatgctcaataaaaataagtaaatcacaagactctgaagtacagctattctaagaatttctaggcacattgcatttagggtaaattcagaggaactgcatttagtctgggaagtaggaggaaaaggggttaaagcatgtttcatcagtatcatataattcttttttattttttattttttgagacggagtcgctctgtcgcccaagctggagggcagttgcgcgatctcgactcactgcaagctccgcctcccgggttcatgccattctcctgcctcagcctcccgagtagctgggactacaggcgcccgccaccacgctcggctaattgttttggatttttagtagagacagggtttcaccgtattagccaggatggtctcgatctcctgaccttgtgatctgcccgcctcggcctcccaaagtgctgggattacaggcgtgagccactgcgcccggccctagtatcacataattcttgccaaatcctaatccttctatattagagagtttaaaaatgttgatattaggttctaatcaaataagtaaatttaaaacagaatgcaaattaccactttcaaagtctaggtctcaaattttcatgtttctcaatgtatacaggtaattatagaagagtgccaaaactaaacctacacacttgacttttatttttgcctgacaagtctaataatctttttttttttttttttttaagacagagttttgctctgttgccaggctggagtgcagtggtgtgatctcggctcaccacaacctccacctcctggattcaagtgatgctcctgcctcagcctcccaagtagctgggactacaggcgtgtgccaccatgcccagctaatttttgtatttttagtagagacggggtttccccatgttggctcagatggtggtctcgatctcttgacctcatgatccgcccgccttggactcccaaagtgctgagattacaagcgtgagccactgcacccggtgtaataatccattttttaaagtatgttaatactgaataacttcttagtctacgaggcagagtaaaaatcggcctccaaaagtttaaataaatagagctaacttaagaaaataagtttaacttaataattttacttctcattttatactattatgattaatattacctataaacaggaaacaacgtgttaaatttatacctcaggacttgttctgaatctagagacagactgtagtcttatcttgttctccactgttgcttgtattctcacacattcctccaggaattctccagctgggcctatctactttttctacaaaagtaccatctataacttttacctaaagctgacaggagaaagaagtaaccctttttcttctcccttaagccacctgctagctaatgtccctctacaaggacctgattggaattaactcccactttctctctgccagagcccatagtttaaagcacagaagctacggttctggcaatcagtcaaatctcctgctttttctcactctggattatagatgaagtacaacagaggttctagcatggccctctgctccatttccaaaactagattactgcttaggacaacagggaaacacctcttttctcttatgcaaatgagtaagattttctcttctaaagaaggatcctgtgaacatcttaaaaattatcaccagctgggtgtggtgctcacgcctgtaatctcagaactttgggaggccgaggcacggcagattacttgaggtcaggagttcaagaccagcctggtcaatatggtgaaaccccatgtctacaaaaatacaaaaattaacctgccgtggtggcgcccgcctgtaatcccagctgctcaggaggctgaggcaggagaatcacttgaacccaggaggtggaggttgcagtgagccgagattgcaccactgcactccagcctgggtgacagagcaagactccatcacaaaaaaaaaaaaaaaaaaaaaatcaccaatgaaagcaactaacagcagctaatactcttatgtggtgttgctaaagttaatgctcagttaggtacaaaaacttaccccctcatccaaaccgatcaactgaactgatataatttttgctttttaaagtttagcatgtagttatgtaggttttatttagttcaattcctaaggacctactatgtgccaggcactgtgctagaccttggaagtacaaagaataaagcccagctgttaccaaatccatgtgcttaacacttagagtggttaggcacaggcaggaagaagaggggaggctagggcataaaatgccatgaacagtgttttcagtgccatgatagtgatttgcacagctttaataaacagtccaagaaacacttcctagggaagacggtgctggacgtaaacccttttcacagtatctttttctttatttttggttaatgttccttatattatctctttaatcattttaaacagtcatgttatagccctttcatgtttttctgtatctcaggttcctgaggtgctaaccttcctgcttatttttacttatggtaggtaaggttctcatatatttataatttccgattttgagttcactactaggtattattttctttgtggcaatcttattttttttaattaaagatcagtaataggaagatatctagaaaatccccaaatatttgaaaattaaacacaaatttccacataatccatgggacaaagaggctgtcagagggaaatcagaaaatgttataaattgaatgaaagtaaataaaaatataataatcaaaacatcaaaatttcaggaatgcagaaatttatagtattaaatgcttatattagaaaagaaagatttcaaatcaaagatttaatttttcattttaagaaaccagaaaaagagcgtaataaaccctaaaaaaagcagaaggaaaaataaagatcaaagcaaaaattgataaaacagaaaacagaaaaacaaaagagaaaaccaatgaaacagaaaatcttttgaaaagatatataaaccagatacacctctagccaaaatgattatgaaataaagaaagaagacacaaattagaaatatcagcaatgaagggataggactctgctgtagaccccacatacttcaaaaagataataaaagcatattacaaagaactttatgcccatgcattcaataacttagatgggatgaacaaattccttgaaaaacactatctatgaaagttcatgtaagaagaagtaaaaaaactaaaacagttcagcccagatgtcttcactggtgaattctatcaaatatttatggaagaactcataccagcagctctttcagaaaacagaagaaagcactacctacctcattttatgaggccagcattaccttgatactaaaaccagacaatgacaaccctgagactaaaaccagaaagagacattacaggaaaattattaaacaatatcctttatgatatcagatgcacaaatcctcaaacatattaacaaattatatccagcaatatgtaaaaagaatgatacaccatgaccaagtacagttatactaagaacagaaggttggtttaacatttgtatgaagaaatttgtataaagaaaaatcatacaatcatctcaacagatacagaaaaagcatttgacaaaattcaacatccatttatgataaaagacagtacactagccagttttcagagcaccatttattaaatagggaatcctttccccattgcttgtttttctcaggtctgtcaaagatcagatagttgtagacatctggcgttatttctgagggctctgttctgttccattgatttatatttctgttttggtaccagtaccatgctgttttggttactgtaaccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattcagcagtggtttgtagttctccttgaagaggtccttcacgtcccttgtaagctggattcctaagtattttattctctttgaagcaattgtgaatgggggttcactcatgatttggctctctgtctgttattggtgtataagaatgcttgtgatttttgtgcattgattttgcatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttcctatgtagaaagctgaaactggatcccttccttacaccttatacaaaaattaattcaagatggattaaagacttaaatgttagacctaaagccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatcagacaaagggctaatacccagaatctacaatgaactccaacaaatttacaagaaaaaaacaaacaaccccatcaaaaagtgggcgaaggagatgaacagacacttctcaaaagaagacatttatgcagccaaaacacacatgaaaaaatgctcatcactggccatcagagaaatgcaaatcaaaaccacaataacataccatctcacaccagttagaatggcgatcattaaaaagtcaggaaacaacaggtgctggagaggatgtggagaaacaggaacatttttacactgttggtgggactgtaaactagttcaaccattgtggaagacagtgtggcgattcctcagggatctagaactagaaataccatttgacccagccattccattactgggtatatacccaaaggactataaatcatgctgctataaagacacacgcacacatatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaactgaacaatgagaacacatggacacaggaaggggaacatcacactctggggactgttgtggggtaggggtaagggggagggatagcattaggagatatacctaatgctaaatgacgagttaatgggtgcagcacaccagcatggcacatgtgtacatatgtaactaaactgcacattgtgtacatgtaccctaaaacttaaagtataataataataaaaaaataaaaataaaaataaataaataaatatattacaattaggcccttaaaaaaaacgacagtacactggtaaaagaaggaagcttcctcaacctaacaaaaaccctatagccaatatcatacttaattgtgaaaaaaatgaattttccccctaacatttggaacaaggtagaaacatccactcacaccaccactattcaatatcatactagatctttcagcaggtataataaaagaaaagaagacacacgggctgaaaatgaaaaaatgaagctttatatttacaaatgtcatgattatctatgtagaaaatcataaataatctattaaaacctgttaaaaccaataaatgagtttagcaaggttgtatgacataaggctaatgtatttctatatgctagcaatagacaattggaaactgaaaatctaaatgtaatatcacttaaaatagcactgaagactgggcatggtggctcacacctgtaatcccagcactttgggaggccaaggtgggtggatcacctgaggtcaggagttcaagaccagctgggccaatataatgaaatccgttctttactaaaagtacaaaaattagccaggcatggtggcaggcacctgtaatcccagctactgaaggggctgaggcaggagaatagcttgaacctgggaggcagaggttgcaatgagccgatatcgcaccaccgcactccagcctgggcgacagagtatccgtctcaacaataaaaaaatgtgttgttcagaaagatcctctactgaaatttgtctttttccctcatgattagactggggttatgagtttctggaaggaagaacacagcactaatgtgccactttcatcatatcataccgaaggtacataaaatcgccatgatttagctctgctgatgttggctgaggtagtgtttatcaagtttcttcaccgtaaagttactccccaaccatccacacacatactcttggaaggaagtcactatgctcaacccatactaaggagtcccggggaagttatgcttcctgtccttgggatagggtatctatacaaatcatttggaattctttggcatggaagatttgtttcttttcttctctttattatttattcaatcatttatatcagcatggactcatggatatttatagtatgctttgagtatttaaaacttataaaataatatctggctttattgcattttgatcaggtcgtataacatttctgtattataacacttatctgatgtttacttttgtgacctgacatacaatcaagttttgtaaacatttcatgtgcacttgagaaaaggatgtattttctattatcagaacttcgagtttaatatatgtacagacctacctatttggctatgttgtttaggccttctcaaaaatctatccttgctgatttttgtctgtcttatcttatactgagagtgatgagttaaagtctcccattattaattagcatgcttatgtctctttgtagctcttgtattttttgctttataaatgtggttgctgtgttatttggtgttaaatacacataacttgttatctttattttgaattgaagtgtgttcttcctcatgtttaatgcatctttagttctactttggtatcagaataataactgctgctttatatgtgtttttctatttttctggtattcttttattcatgtctttgtttttagctttttaattcatgttgtttaggtatatattttctatacagcatgaaatttattttactgccaaattgaaaatactttttgttaataggtgaagtgagttagggctattcataattattgataatgattaatatatttggtctcaacatattatatattatgtataatatgtttttctgctatattttctttctctattatcagttttttttgaattttaaaaatttctgttatatttagaaatattttttcttctgtactagtgattttgtgttttactgtaaatagacctctaatgtaaggatttacgtttaactgtctaggagttggcctgtgtttaaagtttgttgtagctgtaggtgtcagaggcttcagtttcctctagtgtccctgtttttgtctcccctgttatctttgggtttccctagaaactccttcttaaatagggtctgtgtcttacagctctctcagctgtcatctactcttaatttactggagctctgttgacgtggtaggaaggtattgtggaagggaagcaatctatactcctataattaaatctcagtattgttagtgtttgtgattccttgggttctgaccttcagaagagtttctcagtctttttccccctccctttatgttagacagaaaggccatggtggggtaaattggtagtttcctttgagggctggcctttgttactgagaacactctgagagcacttcaaagtggatcattttcctttccccttgccaaatgcatgaggggatttttcccagatcttcaactttgaaaggtggtagtatccagcctgggagtaaaactttcatgaaagtgtgggggcctccttagtttttaactctcaagttatccagattcagtctccagacactagtcaattatcatccaactaatcctgacagttcttgcagcttatgttcccagttagctatgattctttgtattcacctttctctctagttttcagagcagcggtttcccctgagacctcaattatctgataaatctattaagagttattgattttcagtttttcatttttttccttgttgtaggaatgggagtgacagcttccaaactttttacatgtgacaggagaaactggaagtcacaaaagatacagatttacttttctactatttctttctttcctcaaaagtagttaataatccgaattgaagaatggaatgtgctagaagtaaaaggaaactataaagttttattttagtgtgaaggaaagcagaaatcattagactgtgtcatcccctcatttccattatcagtctaccctatctacttctaaaatgtaagcaccctaataatgggagccttgtttgcctggccagctgcatccccagtgcataaaacaccatacggcacatagcacgtatttaataaatatttgtgttagatgaattaaccaggtaataaggtgcttttctcgactctaacctccataataaggctggaaaggagccaaatccagcccatctttcttgtttttgcattcatcatcaattgagacagaaaatagttttaaatcaaagagcctataagcatatgttaaatgctattaaatactcactaacaatagaatttcttcatggcaacagaaaactggctcatcctcttggtcattttggaaatgagattttttttaaacctcattcatagctatgttccattttcttaagatgctgcttatgtttacttactgtatccaaggaattgaagcattaaattcattaggtgttgtttaaacaagacaggaagtatagtcaaaggcataatttaatattttggaacatttggcacagtcaaaaaccaagtagactcctgattagatatgctgtgatccagtttcatgaaactcaactagaatgcttttactatgaaataacttttgcagctgaactttttgacttccatatcaggatgtcaacatatcctttaatatatttcatcctacttataaatatttcactataattatagcattttattaatttattttccaatatataagctagtatttgtaatgtgcaagtcaatatgttaagataaaaagagcttattgcaaattttttacagctacaggtgattttttcagaggtttaacactagctgcacagtttatacaaattattcgcaaaggaagatagcagagaacttactagaagctaatgtggaaaaaatttcaaatataactagttgagaaatttgaactttattctgaaagtaatggggagcctctgaagaatttcaatcagtaaaacacccagattatgtttcacaaagattatttaattcccttcactgcactattttttaaaacttatttactgtgttttctccaactagaatataaggtcgacaagactacagcacatatctgtgtattcactgttatatcccctacaccttttataatgtcaggtgcgggaggtaaacaaaaatggctgaaaagctaatacttttttctttccttttttttggccgtgaaccaccaccaccaccaccataataattaaagtcttgaacccaagaattgttagtgagggcacaaattagaacactctgaaaatattaaagagcaagaattaaacactggtgaccaaaaggatatgggcaatggggaaaagtaaaagcaggaatcttttacagtatttcaaaaattaccataaaactacagcaataaagacagtataataatggcataagggacagacaaacagatcaacagaatagatttgagagtccagaaataaaaacttatatttggtcaggtgcaatggctcatgcctgtaattctagcactttggaagaccaagaacgggaggatcacttgagcccaggagttcaagactagcctggacaacatagtgagactccctctctacaaaaaataaaaaattagctgggcatggcagcacacacctgtagtccctactgcttgggaggctgcggtgagaggatcatttgagcttaggatgtcgaggctacagtgagccatgattgtaccactgtaccccatcctgagtgacacagcaagactctgtctccaaaacaaaaaacaaaaaaaccttaaatttatggtcagttgatttttgacaaagacgcagagttcaatcaacagggaaaataatatttccaataaatggtatggggacaactgggtagccacatgcaaaaaaataaagttggacccttaactcataccatatacaaaaattaactcaaaacagggctgggtgcagtggctcacatctgtaatcccaacactttgggaggccgaggcaggcagatcatttgaggccagaagttcaagaccagcctggccaacctggtaaaacccccatctctactaaaaaaaaattagccaggcatggtggtgtgcgcctgtaatcccagctactaaggaggccaaggcaggagaatcatttgaacccaggaggcggaggctgcagtgagccgagatcataccactgtactccagcctgggtgacagagtgagactccatctcaaaaaaaaaaaaaaaaaaaaaaaaaaaatcaattcaaaatagatcatagatctaaatataagaaggaaaactgtaaaatgctattttctacataaaagtaaatcttcataagattaagatgctcttagacacagcatgagaaacaaaataaaaattagataaagtggacttcatcaaaattaaaaattttgtgtatcaaaggacaccatcaagaaggtgaaaaaaaccacccacagaatgggagaaaatatttgcaaaccatgcctctgagaagggacttgtatctagatacaaataaagaaactttcaactcaacaataaaaagaaaaataacccagttaaaaaatgggcaaagatatacaaatgggcaacaaggacatgaaaagatgttcaatgtcataagccattaaagaaatgcaaatcaaagccacaatgacaccaatttacacccattaggatggctaaaatgaaaaagaccaacaatagcaattgttgatgaagatgtggagaaatggaaccttcattcattaatgggattttaaaatcatacagccagttttgaaaagtttaaaaaggtaaaacaaagttactatgtgactcagcaattctactctacatatacaccaaagagaaatgaaaacatgtattcacacaagaacttgtaaactaatgcaacagaagcattttcataacagcccaaaagtagaaccaacccaaatatccattagctaatcaactgttacacaaaatgtggtatatattcatacactagaatattattttgttataaaaagaaatgaagtacaacatagacgaaccctgaagatattacacaaagtgaaagaagccaggcagaaatggacaaatattccataatttcatgtatatgaaacatccagagtaggcaaatccataaagacagaactaggggtagtgggtaaataggtggtgataattaacaggtaccgaggtttttttgaggggagtggtagaaatgtcctaaaattagatagtggtaatggttgcacaactctgtaaatacactaaaacccactaaactggctgggcgcggtggctcacgcctgtaatcccagcactttgggaggccaaggtggttggatcacctgaagtcaggagttcgagaccagcctggccaacatggtgaaaccctgtttctattaaaaatacaaaaattagcagggcatggtggcgggcgcctgtaatctcagctactcaggaggctgaggcaggagaattgctggaacccgggaggcagaggttgcagtgagtcgagatcacgctattgcattccagtccagccaacaaaagtgagactctgtctcaaaaccaaaaaaaaacacaaaaaaacaaaaaaaacccactaaactgtatacttaaagagggtgaattttatggtatgtaaattgtatctaaataaagttgttattaatattaacacacacacactcacactcacacaacttgtagacttttgaatagatcattctccccctggtgctttccgtctgactgatgcaaaattctcaatttccgcaaataaaaacacaaaaactgtccaaaatttatataggtctgaaagttaatttaaggaattattagaatataaagtccttgaaggctacaaaaatatcatagttctacttcccttcttcatactattttatacacagtaagtgctcaataaatgtctgctcaaatgaatcttcaaaaagagattagggagcttaaatgttcagaaagaagtacttttatagcaaggctttccaggtgaatactgacctctgaatttcatctctttatttagtctttggccagtttctttaggaagagagatctgagaaatctttagaacatgaccgtaatatagaagatactataattaaccttcctgcatttttaaattaaaaacatccttctgcctatagtcccaggtactcagaaggctgaggcaggagaactgtttgagcccaggagtttgaatccagcctgtgaaacatagcaagatccctgtctcttaaaaaaaaaaaaaaatcttcatacagaaaacctctatagcagagttaatacaaaacacaaaaaacatcctgttatcctcttggatcagggaatgaggtacgctggttaataccaattgactacatacagattagtacttactaaatgaatgggaacaaaatcacaacaagatcacaatctttcatggataaatcagaaaacatttggatatgttacactgccttagggtcattgttataatcaactatcattatttactatgttggactgcttttgcccatgtactcagtaaggaagtttcagttgaagtaatactaggcagaccaacttttaccacaggacattaaaaccaagagaactgacagctcaaccctaaaagctgaacatctttttttttctctctctttttttttttaaataaaataggcaattcacctgtctggatctttcctcaaatctgtttccaggtcctgcaaagtttacctttaaaaaagcatgattgtacatgagcaaaaatacatggcctaaatatgtgtcaggcttgcttactggaagaagggatataatttccagaaaaatacagtaacatgtctatagaaaaatcatatgtaggatgtaaagctcttacaaattaactgttaagtaaacagaatttctgccttagaacttcattaactatgttaaatgaaggtaagtttagcctccctttcctcatcctctttattctctagtgtgtcctctaaaaaggcatctttgagaaaggaagctacaaatttttgtccttaaaagtcaactcaaacacatttaaagaaactaagattgtattaattatttaatagttatgtatattcactaggcaaagaatctggcactgaaaaaaatgatccacttttcttctgggttcccatatacaggaatcaaaataatttacaaagatttgtacaatgaggaacagtggactcaaaaattcaaactttgtgatattaaaaagtaacttcatgtttattagatgtaaatagttttacattgtatatgtcattttctaaaaaaaaaaaaaacaaaaattgacaattggatcctatatttaagtgttatctgaacatgtcacagaacaatgttctaaggctcacagcaggattaggcttacatttaaatcactgacattatttggtaattattcatcttggataaaatctaatctgaccattcatgtcataaaaccagagtccacaaagttggaaggtatccaagaactcactagtgcaatctcctcatttcataaaagaacaaagtagggccaatcgaagttaaataatttgccccaaatgcccaaagatctcaggattagggtacagcagactgcaagctatactactttatcaatgaagctaactaaatcccatttgaccagaaataaatattttccaaaggcttaatcaattttgttctttcatcagagtttggaggaaaatataaagatcacctagcaatcacttttagtaatatgagaaaccttcaaaatatttctctagtacataaaacaatgcaaaattaaagaaaccacagaagtccaaagctagggttgtcccagctatccttctccaatagcaacaagatgcacaagaatgttacatctaaatttgacttaaggaaaggaaaatcacatacagagcaacagaataacttaatccacaagctgcttccttctcaaataagtctgaagggtttgtccatttttccaccaacctgttgcactctgctttggtatttctccaccattgcggtccacacattcccaaggagggtctgactacttagaccttgacatctggaaagttcattgttccccagcttctcctcaccacccgtgaaaaagaccagaaagattggttgactgttcttggagatgagatgacaggcctgcaggtgcacctgtagcctctgacctgccagtagaatcttcacttgcatgactaaagcagcagcttagatttccagaaatattagcagttttcatttaaactttctctagagaccctgggcagatgacatgaatgaactgctcaaaaatttcctcagcaaacctttaactctcatttttgctgataccattatttttgtaggaataagggagagaaattacagagacagaaggaaagaaaaattttaaagaaagaaaagcattatttgctgtgtaaaggcagttacccaaggctaatatgcagtgtgtcaaaggtataactgaaatatcttaacctgtaatccaaatccaaagaataaacatgaacattaaaataatactgaagcataaaggtctgaaggataacagatatccacagttattctgcaggaagacccatagactaagttggctttccagccctactgaccatccctagaggcttcaactgtgagcctggtagaaaactgtattagaagttgcaatgatttcattttctccatctcttgagatgctaggaaaggtccaaattacactctgagtgctggagcaaatgttacaaaaatgtacaaaattacttgtgatgtcactgaagaaagttagcagacaactaggagaagaatgtcatcaaaataaataaactctcaaagagattggcatgcattacatgattctcaatcctattcaatcaattacattattttagtataattatctatttccttagactaccattatttaaattagatgatctaaaaccatgctaatggggaaaaccctaccaatcaaaaaacgaagaaaagaaaatcctagactcaatttcctcaccccgacagccacaatgcataagaagagaagaaagaatatgtcaacaatatgtatacttagtagagcataagtttattatccagcccaggacactactgaaaatgaaaaaggacactattaaaaattataccaggcaaagatgcagaacaggaactctcattcattgctgatggaaatgtaaaatgttaatagccacttcggaagacagtttggcagtttcttataaaattagaaatagactcaaatacaacctaaaaatcatgctcctacgtatttattcaagtgaactgaaaacttacgttcatgtaaaaatgtgcatgtgaatttttttttttttttttttgagacggagtctcgctctgtcgcccaggctggagtgcagtggcgcgatctcggctcactgcaagctccgcctcccgggttcacgccattctcctgcctcagcctcctgggactacaggagtaggtgggactacaggcgcccgccaccacggctggctaattttttgtatttttagtagagacggggtttcaccgtgttagccaggatggtctccatcttctgacgtcgtgatccacccacctcggcctcccaaagtgctgggattacaggcgtgagccaccgtgctcggccatatgtgaatttttatggcagctttattcataatcaaagaactggaagcaaccacatgtcatttaaaagaagaatgggtaaacaaattgtggtatatccatacaatgtaatattatgcagtgacaacaaggaataacctactgattcacacaatgagatggataaatcttaaatgcattttgctaagtgaaaaaagatctgacagattacatactgtatgattccactcatactgtatgattttattcatataatattctggaaatggctaaagtaaggaatagaaaacatcagtggttgccaggggttgggagagtagagaatggtttactacaaaagggaatacaagggaacttttagggtgatggaactattttgtatagtactggggtagtgaatatatgacactgggtatttggcaaaacccaaagaactttacaacataaaacatgaactttcatgtataaaaagtttaaaaaatcagccaacaagttggcattcccaggatggaatgtagactgtgaaaaagaacctaactattataaatgtatgacataatatctctgagaatatgggggaaaaaaaggagtggacctaaataactttggaaaataatattttgactgtaaacagtaaggctagaggcaaaagaacttgtacatgaatactgtttcttacttggtaaagctgtttctcacaggggtatgatttaacatttctgaaactgctttacatgtatactacagtcgaacaaacaggtaaatagatgctacatcatagaagccagattactcactgttggaaagttacagataaactaagggggaaggctacaaggaatactgtggtattggattggagacagaattatcaatatgaattcatgtttaacttaatgtagatacacaaataattatagaaacatgtgtatacatgaataagtatacatacatttccttgctctgtctgtggagagggcctaggaataggaatgtccagaagcaatgatcatatccacaacccagatattggtttctaaataccactattcaattaaaaacaaaaacaaacaaacaaaaaaaaccatagctccttggagaaatggctacttctatgattaggctgggaaaatacaagataaaccagagtatcttgtagtaccagaaagtaaggaagtgttcaacaaaaggatggggttatgtcaaagggaaagagctcccaatggccaaagctggaacaatttgagcaacaaaataacatgttaatggagtataactcaaagtataaataaatatccctgagtccgtattgatacagataaatggggagaaaagagagatattccttacagaaaaattccaattaatttacacagataccctccaagagcttaacttacccccttgagtgtgggctagatttagtgactcacttccaaagaacagaggatgaggtatggggataacattacagtagagaaatctgccagacactaccttggccagatgatcaagattaacatcaacagtgataagtcataacgtaaaatgtagtcctgaaattatgtgaaaagaagggcaattcatctctgtatcattctgaaaaaccataaccccagtctacataagcaaacccaaactaagggacactccacaaaatagttgaccaatactcctcaaaactgttaaagtcatgaaaaagaaagaaagactgacaaagtgtcacagaatggggaaaataaggagatattacatctaaacgtaatgtggtatactgcattggatcctggaacagaaaaaggtcattagtggaaaagctggtaagatctgaataaagtctggagtttaattaatagtaacgtaccactgttgatttcttagttttgacaaatgtaacatgattatatcagatgttaatagaggaaactaggtgagggtatagggtataaaggaactctctaaaatgtctttgcaacttttccataaatctaacattattccaaataaaaagtgtattaaatatgtgccaagaaaatagatataagccagaatcatcctggaaacactaggacattatgctcatctgatgtatgacccaagtctacttttgctcttaacatcctttcagtgttaacaatctagagaataattgagtttgtgtgatttagtaataaatgaaaaatctaactggattctatcatagctatttttttaaccttttttggaatttctagctccataaaatacaaaataatgcttcaaataaggttccttgaactgatggggggagggtggggagaggaaatgcagaagatgatttgtgattaaaagactttttaatacttagaaccacctttttgctcacatttttatatttagggcctaagtattttattcttgtggaagagataataacatggctattggaaaagaaaccccatctaactcttaagatcagtggtgaaccaggaggcccacaacactgtatctacagctcatgagagataagaaagaaaccaaacagaagagttttttaaaaataccatgtgtaatgataagagggaataaagaaaggcagtgaaaactgactaacctccttctttcctggctagtaagaaatagattttatttttaaattaactctttgtataactgtctactgtaagtataaggactaataacatccttagagagctcctgctgccagaaatagtttctattccaagcaggggatggggggattacaaagcaggtacggaaatcatttgaaagcaaagatttttcttgatgctttaccccattcaatagctgtatgaggagggccaatgttttaggaagttattggtacttctagtatactaaaatggtataaacccatattatatttcctttgtggagggtggcaaactagaattactgccaaagttactttgtagtatgtctaatgtatcaatacatattataactgaacctattacccttagtttgcccacaaaatccatttcattcatgtattaaataaatatttactttatgtttcttatgcgccagcactttttgaatgcttcatagattttgaaaaaaaagatacatgctcatttttttttaagactcaagcaagtcaaacaagtacaaaaataaaaggggggaaaaatcaccctacaacctcctacccagaatttaacccttggtgaaaaacaatctagacatctctctttgccaggcacattaatacatattttataaaaaggattttagccattttactaatgggaaacatttctttataaaaaaaacaactattaagcttgatgtttataacaatattaatcctagactcttctattattaaaaatgacctgagaattcaggccaataaggcttcacctaaaacatacctaatagaacctttctctaattaaaagtggaccctagatgaaaataaacacaggtatacatgttttaacatcggccaagtgtaactttgcttgtatgtaaagaagctaattgggcagcagctctgtcagtatactgaagtagatttcaattggctgcctattttgagttaacccatagaaaataaaacagtcagatactgcttgcagcagtgaacggtaatggctttaaaaatttttttaaaacattctttaaaagagggtatacaacaagttgcatatttttcttgatctttagttccatgttcatctttaaaattctcaaaaaaaagttttcagtcattttcttattagatacaattttaaagtaacttgagcatgattcattagcttaaatctgacagagaaaaatgactacacataaggctttcacagcatctgaacttttaatgcataaaccatgtcaaataatttttcataaggaaagagcaaacattactgtcttctaaccggtaggtaatttcctcctcttccttttagtctcagttcatcagtattgatacaggtgacttgttgggcaccctgaattccatcctggcctccttcaacgttcccttcaatttactctagtgtcagaagtacaagcaaactttggattggccccagaacagttatacccagacttcaagcttggcactccccttcttgaaacttagcctgttttgattcctctcttattgtctcatatccaatacagtgtcctttataccaaactggggactgtccataactctacctattcttctcaatatcatttatgatattgatgggtctactgattttttaaaaaacagtatttggttttattcatttttctctatattttgtcttttatttcactgattctgctctatattactgccttcctttacattaggtttaatttgctcttcttttctcgtttattcaggtagaagcttagatcattattgtaaagcaattaattttcctctagtattgctttacctgcatcctacaaattgacatgttgttttttcatcttcattcacaatattttctaattttccataaaatttcgtattttacccatgagttatttagaagactattgtttaatttctaaatatctgggaattttccagatatctattatagtgaattctaatttaactctgttttcagtcagggaatacattctgtgatttcaaaacttttaaattattgagactttaaaaatatcacccagcatatggttaatctaagtgaagttctatgtgcacttaaaaaaaagaatgtttactctgtacttgtttggaggcatgttccataaatgtcaattaggtcaagttggttcatagtgctgttcagtcttctaaatccctatgaattttatgtatacttgttctattaattgttaagagaggagtattaaaatctcctactataactatggatttgtctatttcagttgtcagtttttgctccatgtacttcaaagctgttattatgtacatctatgcacattaagaatacttatatattcttgatgaattgactgttttatgatttatattagggtggtgcaaaagtaactgcagtttttacgattgaaagtaatggcaaaagccacaatttcttttgcaccaacataatacatgttcctttttaacccttgtaatattctttgctctgaagtctgctttgagattaatacagctatttcagctttcttgctatttgtttgatacatatttttctatctctttggtttttatattcaaagcaagtttcttatagacagccaagagtttcttgctttcatatgcagcctgaaaatctttgctttttatctggaagatttagaccacttagagttaatttaattactgatgagactgggtttaaatctaccatcttactatttgttttctgtttgttctctcttttttcctcgtttcctgccttcttctggattattttttagtattccattttatcttctctatttggcttatttttcaagtggttcttctaggatttggagtatatgtattttacttactgtattagtccattccctgcattgctatgaagaatacctgggactgggtaatttataagaaaagtggtttaactggcttacggttctgcagactgtacaggaagcataacaccagcatctgcttctggagaaggctctggaagcttacaatcatggcagaaggcaaagcaggagcttgctcatcacatggcaaaagcaggagcaggggagggaggaggtgccacacaattttaaagaaccagctctcataagaactcactaccatgaggacagtaccgagatcatcgtactaaaccattcaagataaaccaccccccatgatccagtcacctcctaccaggtcacatctccaacactgaggattacaattcaacatgggatttgggtggggacacagatccaaaccatgtcacttatcaaggtctaccttcaaattatagtataaccttttctgtaaaatgtactaacctttcaacaatatacattcattattcctctcctaccctttatcttgttttcatacattttactacctcatatgttatatgtcccacaatatattgctgggtttttttgttttaaatagttaattatccttaaatttttaaatgaggaacaagaactctgttatatttactcacatatttagcatttccaaaatgcttcattcttctgtgtagctcagtttccattaggtatcgtttcccttctttctgaagaacaatgtttaacatttctcatactggtgatctgtttgtgatgacttctttcagctttgatttgtcaaaaaagtatttcacctctatttatgatattttcaatggatatagtaatctaggttgacagctttgtttttcctctcaacactttaaagatgtcattctcttatcttctgacttttatagtttctgatatgtcttgataagcatacctttattcctctttaataggcctattttttaatctacctgaatttaagatttttctctttatcagttattttcagcaatttgattatgatgtatcctggtgctggttttctttatgattatcctgtttgtggcctattgagcttcttagatctggaagtttatgctttccatcacatatgaaaatttttgaaacattattactttatttttctgtgcccaccttctggtgttccaattactcattttttaaaccacttgatattggcctaaacattaatgaagctctatacattttttcatcttctgtctatgcttcatattctgcatagtaatttttaatataattgatcttttcttctgcagtatctaacttgtctgtaatttatataagtgaaattcattaaatatactttatatttcatctttataagttccatttggctctttatattttccatttctctacttatgttgatttttgttttaattacttgaatatattgaatatatttattgtagctatttcaacattcttgtttgtctgctgattccattatttctgttttcaggtctgtttctattaattggttttaattttgatttttgagctatgtttctctgcctcttgacatgtctagtaatttttttactgtatgccaagtagttgattttatgttgctgagtgttagattctgctatatttgtttaaagaggattgatctttgttctaacagacagttaaattacatctgaacccatttgatctatgtggagtttcatttatggtggcttagactagtctttattctagaactaatttattcccactacaaaggtgtgacccttctaatatctcccccaaagaacccacgtattctgtgagtgtttttcactctaatgggaactcaaatgatttctggtcctgtatgttctctgggaattgttcagctcctcaataactttttctaagaagttgtttttgcacactccatggaatttcaccttacccatatataggactcaaagggactcctaaacagattatctagaactttttttttccatagctccctcctgtctgttatatcaccttgcacatcctagttaccaagacctgcccaaactttaatctatgtctcccaccattcagcaataccacaggcgctgtttgaatttcccttccctgcaccaagatctggaagttgcctccaggcagaaagccaagacaatcatagagttatctcttttgtttcctttctctcaggaatcaacagtgttgttacctgttatcccatatatgaagacagttgtttcaggtacattgcccagttattcagttgtttatagagaaatggcaattctagatcctgttatttcctcatggctaaaagcaaagtcctttctcatatctgattgtgtgtcaaatgctatatataaaataactgtagagactacggttgatgttatttgccacagaggatttgccctttctttttttcctcttcttttttcttttttttttttttttttttttgagacagggacagggtcttgctctgttacccaggctggagtgcagtggtgcaatcatagctcactgcaacctcaaactcctgggctcaaggaatcctcccacctcagcctcctgagtagctaaagattacagcacacaccaacaggcctggctgattttttatttttatttttatagagacagggtctcaagatgttacccaggctggtcctgaactccaagctcaagtgatcctcccaccttagtctcccgaagtgttggggttacaggtgtaagccactgagcctatcctttgccctctcctctgttacgcagaaaggaactgagctaggatgagattggaatgaagctttagttagattctgctcacttctattttcaaaaatctcaagggtgaaactgtcagttgtctgtgtaggcatcttcctctagattagtagttctcaaagtatggtctgtggatccccaggggtcctgagatttttttttttttttggtggtcgagggggaagcatgaaataaaaactgtaatatagtaatactaagatattatttgctcttctgtgttgacactagcactaatagtacaaaagcattggaaggtaaaactgttggagacttaacatgaatcaaggcagtggcacccaatgtacatttatagttttcagtgccatatacccacagtaagaaaaaaataccaattttacttaatgtccttgatgaaccagtacaaatggtgaaatttattaacttttgacctgtgagtacatgtcttttttataatctaaattacaaaatgagaagtatatataaagcatttctgccatataccaaaatatagtccttgtctcaaggaaaagagcttgtgtgattcttttgagttgcaagctgaattagctggttttttgttttccatgaaacaccacttttacttgaaagaacaatgaatagacaaattatggtctttcaacttgaatgtttaataggtgtttcctctaaaataaatgcagtaagaaaaataacagtatttgttgccaaaaataaaatttgagctttcaggcagaaattagaattgtggaaaacttgtatcagccactataaacttgacagcttttcaatacctaatgactttttctaatgagatcagtggtgatactaataaatatggtatttttaaatatcataaaataaaacgtcaatgtttggaagagaagcatacctcagtaaaccaacatttccaaatgatcaatgcatggtacaaaattatggacgggtaaaaaaacccactcaaaatacaaaacagaataacacattttaatgtaataaagttcaaaaagtacattgacatggtttcagattccactctgtaactaacctttaagaaactaccacctgtcaaatttggggatcagatcaaaaaagaatattcacaattatctgaaaaagtggttacattgctcctccttttcccaactgcttatctgtgggaggctccattttctcaacttattttaaccaaaacaacacattgcaacaaagtggaagcagaagcagataagaaaattcagctgtctcctattaaaccagacagtaaagtgttacaaaatacaaaacaatcctactccttagtaatatctttttgtttttaaaagtgtaatcctttttccaaaaaatgtttattaatgttcacatgtaatgggtctattattgttttaaaagtaataaatatttaaaattcttacttttaatttctgaatttctgatacagtaaatatcaacagatataagccacaaaagcaaaatatccttgggggtcttcaactatttttaagattggaatggggtcttgaaatcaaaaagtttgagaacctagcaagtctcctaagcaccatgagactataagagattcaacttggcttttctagactggccctcagcctcccatactgccatagcatttagcaaatacctagtggagaaaaataagtctgcgaatttcaggctcccttagatttccatctgtcaaaccagcccatacaactattaaaaggtcatttgacttctcttttcctgcgtgggctcccccacctggaccaaacctgatctagaaacatgtccatacttggaaactgtcctcaggagaaaccaattggccatctcagttcacatgagaaaggggcttccctctctagactttcagtgtatctcctcttttcttccacagctcccctatagctttaaaaataagatttttagaatgtattcatattctacacaggaaatggtctgtcactatctaccacatattatccaagggaagaaatcttttaatccactaaaaaataacaaaagctagcacatataccacctgccaaacaatcttcccagcattgtatgtaatagtaactcatttaattctcaaggcaacataataaggtagataatattactatcctcactaagtcacacagctggctagttagcagtgaagccaggattcaagcccaggcagttgtttcagagtacaggcccttagcctctaacaaggtacctacccttggtcttatctaccacacattttcccccaggaaacagcccattttcagagttgtgactatcacctgaagtcgcaaaatcttgatctccaagtctcacctgtccaactgctggctaaacttcaacctggatgttcagcatattataaaaccaatgcatcttcttcacagtcctgaaacctctttcccaaactgtcaccaattctttagcatccttcccacccttggccaatctgggcaattatgatcctatcttcccctaagtttcagatacatttatgtctataccagtaatccccaaacactgatttccaaccaagtttacaatggtgcatataaaaaagagaaaaatagtaatgtgctattcatttttaaaaacctgtcttttattctgagataattcctactatttactgttagaatgtttttgtttttccttttatgaaaaaatgataatagataatagttcattttatatttttttcttagtgaactaaaacattaacaatactataatgattcccaaagttagctgctctgaaaatttactaacctaggaaatttttatatcagcaatctttttttttccctcaaaaatggcagattagaggctttgttagcatacctcatccatttggaaataacaaaatagtgtgtagagattcatactgtgaacttttatacaagaaggaacacaggagcttaacacaaaagtgaaagaaacttcagatactttgaaaaataagagcgggcagcagcttgcactgcaggtcaagcagaaaactgatgtgaattcccagtatgtgagtggggggagtgtctccacaatacacattcctactggggagccaggcaatccaggtcacaggggagctttctgaccctatcaagtgctgatagtgtcagggagcagtggagagactgtgagaaggagcagcagagggaagtgctccatgcacactcccagaccttggggtcaatagaaggtcatttctggtcctaattaattaggggacacatggatgcctaccaaccagaataggcagcagtcaatgatttggagaatctctggactggcatttgtgatctagtctcaagcggggaggacaccccacagtcagaaccaagaggtgaatgtggtgtgagctccagctgcaggtgcaggagttaggcccccaattccctctttgtgggactggactgggaggagtgtggcctgggggccgcagtttttgtcctgggagtttggcagactggggtggttttgcaacctgaggatgaactgtttgtgacttggctggctgtctcagcttgctgcaagaggtggtctgcaagagaaagtcttgctaggtcaagaccatgggagcaatgcaggtcccactaccacgtgctaagctgtggagctcaagcagtccctttttccccatactggctctctagcatggcagtggttgtcctactgctccctggagtgttgctccaggggcttgaaaacagccttctgacccttatcagggctggtgtttgcacctgccattggagggcctgagcacagacttgcctggcccagctctacccagctctgccctgccccaactgccttagagacagaccataggttatggtaattgcagaggttgcacaaactttgtctccttcccgagcactgtgcaattgtgtcagcagatactataatgcgctgaacttcagaacctgaagacaagtctttacaactaatccatagcccagcccgttgcatgggacatccaagtacttctcctggttaacaaaggtcaagtataaacactactgcaaccatcacagcaggctctcacctgtaagtatcaattactggccaggaggtcaacatgcaaagcccattacagtatctgctgatacaactgtacagtactcaggaaggacacaagctttgtgcaacctttactattaccattacccacacaagcccggctactcaggagaccttgagcctactctccctactggtacattactactacaactggcatttgagaaagctgctgcattaaggctttttataaccaaggaaattatacagtgtctataccagtgaatgcacccaaaagcaaaactagacaaccctactaaacatcatcatagacacaccctcaaaagaaaaaaaagtcctactccaacaaaagtaattcaaaaataaaaagaagcgactgttaccccagatgtgaaggaatcagcataacactgaaagtatgaaaaaacaaggtgctatgagatcctcaaaggagcacagtacatctctagcaatggatcctaacgaaaaagaaatctttgaaatgccaggtaaaaaattaaaaatactgattttaaagaagctcaacaagataaaagagaaatctgaaaaccaatacaaagaaatcagaaaatcaactcaggatatgaacaagaaacacaacttctagaaatgaaaaacttgttcaaggagttacaaaatacagttgaaagcttcaacaacagaatagactaagcaggtgaaagaatttcaaaacttgcagacaggccttttgaactaacccagtcagacaacaattaaaaaaaaaaggaatgaacagctgagcacagtggctcatgcctgtaattcaagcactttgggaggccaaggcaggcaaatcacgaggtcaggagcttgaggccatcctggccaacatggtgaaaccctgtctctattaaaaatacaaaaattaggccgggcgcagtggctcacacctgtaatcctagcactttgggaggcagaggtgggcagacttcctgaggtcaggagttcgagaccagtctggtcaacatgatgaaaccccatctctactaaaaatacaaaaaattagccagctgtggtggtgggtgcccataatcccagctactcaggaggctgaggcaggggaattgcttaaactcaggaggcagaggttgcagtgagccgagattgcgccattacactccagcctggtgacagagcaagactcagtctcaaaaaaaaaacaaaccaacaaacaaacaaaaaaaacaaaaaagaatggacaaagccttcaacaagtatgggactatataaaacaatcaaacgtataaatcatagtgtattagtctgttctcacaataaagatataccagagactgggtaatatatatatacacacacacacacacatatatatacgtatatatatgtatacatatatacgtatatatgtatacatatatatacacacacatatatacatacattttatatatatatatatatataaaaatatatatacatgtgtatatatatgaggtttaatggattcacagttccacatggctagagaggcctcacaatcatggcagaaagcaaaggcatgtcttacatggcagcagacaaacaacatgtacaggggaattgccctttataaaaccatcagatctagatggttttataaaaagcagtttatagaactataaactagaactagaactataaactagaactagaactcactcactatcacgagaatagcatgaaggtaactgtccccatgattcaattatctccccaccaggtccctcccacatttggggattatgggaactacagttcaagatgagatttgggtagagacatagccaaaccatatcattccacccctggctcctcccaaatctcatgtcctcatatttaaaaacacaatcatgcctttccaacagtcccccaaagacttagctcattacagcattaaaccaaaagtcgaagtccaaagtttcatccgagacaaggcaagtcccttccgcctaggagcctataaagtcaaaagcaagttggttacttcctagacacaatgggagtacaggcattgggtaaatactcctgttccaaatgggagaagttggccaaaacaaaggagctacaggccccatgcaagtccgaaatccaacaaggcagtcattaaaccttaaagttccaaaatgacctcctttgactccatgtctcacatccaggtcacgctgatataagaggtaggctcccaccgtcttgggcaactcagcccctgtggctttgcagaggacagcctccctcccagctgctttcatggctggcgctgagtgtctgcagcttttccaggcacatggttcaagttgtcaatggatctaccattctggtgtctagaggatggtgaccctcttctcacagctccattaggcagtgccccagtggggactttgggtggtggctctgaccccacatttcccttcttctgcagcaaatttcttcctggacatccaggtgtttccatacatcctccaaaatctaggcagagattccccaacctcaattcttgttttctgcacacccacaggaccaacaccacatggaagctgccaagacttgcggcctgcaccctctgaagccacagcctgagctgtatcttggccccttttagccatggctggagcggctgggatgcagggcaccatttccaccaagtccagcagctgcacacagcaggggagccctggaccaggctcaagaaaccatttttccctcctaggccatgggactgtgatgggaggggctctccagaaggtctctgatatgtcctggagccattttccccattgttttggcaattagcatttggcttctcattacttatccaaatttctgctatgggcttgaatttctccccagaacatgggattttcttttctacagcatcatcaggctgcaattttttcaaacttttatgctctgcttcctcttgaatgctttgctgcttagaaatttcttccaccagataccctaaatcatctctctcaagttcaaagttccatacatctctagggcagggcaaaatgacaccagtctctttgctaaagcacaacaagagtcaccttcggtccagttcccaacaagttcctcatctccatctgagaccatctcagagtggactttactgtccatagcactatcagcattttggtcaaagctatttgacaagtctctaggaagttccaaaatttcccacaacttcctgtcttcttctgggccctccaagctcttccagtctctgcctgttacccagttctaaagttgtttccatatttttgggtatctttacagcagcccctccttctacccagtaccaattcactgtattagtccgttctcccactgctaataaagacatatctgagactggataatttataaagaaaaatgaggtttaacagactcacagttccacatggctgggaaggactcacaatcacggcagaaagcgaacaaggagtaaaggcacgtcttacatagcagcaggcaagacagcacgtacaggggaactgccatttataaaaccatcagatcttgtgagaactcactcactatcatgagaacagcatggaggtaaccgcccccatgattcaattaccttcccactgggtccctctcatgacatgtggggattatgggaactacagttcaagatgagatttgggtagggacacagccaaaccatattacatagattaatattcctgagggagaggaaaaagaaaaaagtctggaaaacctttttaaagaaataattcatgaaaacttccctattctaacaagagatttagacatccagatataagaggctcaacaaattccaagcaaatacattgcaagaaggacctcacttcaacacagagtcatcagactgtctaaaatcaatgtgaagaagaaaatcctaaaatcagcaagagaaagtatctagtcacttataaagaaaaccccatcagagtaacagcaaacttctgagcagaaaccttacaaggcagaagagattgggattctaattttaaaatgcttaaagaaaaaaaaaaactgtcaactacaaattttgtaccctgcaggaataaatttcataagtgaaggagaaatagtctttcctagacaagcaaatgctgtagcaattcatcgccactagactggtagtataagaaatgctcaaaggagtcctaaacatggaaacgaaaggtgatacttgccatcataaaaacacgtgtaagtatagaactcagaggtcttataaaacaattacaaaaaggaggaagagaaagaaattaaataggaacacaacagaacacaaaaccacaaacagaaaaaaaagagagagaaacaaaggatctacaaagcaactagataacaatcaatatcatgacaggaaaaaaaactcacatatcaatattaaccttgaatgtaaatgcattaaatgctccacttaaaagatacagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagcggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaagatacagaatggtggaatagataaaacaacctgaaccaactatatgctgctgacaaaaattcaccttactagaaatgggtacaatgtaaactttacaggtgatggttataccaaaagcctagactttagcactatgcaatatatccatgtatcaaaactgtacttgtacctcctatattaatacaaaatttttaaaatttaataaaacaaaatcagtaaactactgatctatctcagctttatcaatttatcagaatctgcctttgactttcccacctctcttctattaataatatagtcaggtataagcaatcggtcaggtatcctacccaaacacactcaaatgcaagtaataaaagtaacttttatggctatatcaaaaattataaaatgtattgaaattggttccaaatgttattatttaacttttttagatgatcaaaaaagatacaacttcttactgttttagatccagttaactagccttccttactctacagctcacttacctgagtggtaaggaattaagttaactgtttccaatagctttgtagggaaacctttttatagtctaaatcatggtaagatcatctttaccaagcactttctgacatacaatcttatttaatcacaaactctaaatgtattttcatcaatttttgcttctaccaccaatctgatgataaaaagtatgttttgaatgatagaatatgggagttagatgaaacccaaaatatcatctactccaaactcttcctttcataactgagactagtgatacagcttaaagtcatacagctagttagtgaatgacacagctgagaccagaaagctaactaagcccttcagctatctagctggctatatcaagaaggtcaaattcacaagagaagaaccataagtgagatagaaccaggctggaaatcactatactcttaaagttaagcaggtgaagtgggtagaataacattcataaacagcttcactaatgtttaaaggaagcagaattgctttgggttcacagatatcaaaagtcatgctgacatgcaatctccaggggagattagaaaggaagaacaagaagtcagtgaggagaatgaaccagaatgaatttgctctgctctcctatttagccactgactgggggttggggagtgtagtgcagtcaaaaggttagggttttggtccatcaagagatgaacagataaacaaaatgtggtatatccataagatgcaatattattcagcaatacaaaggaaagaaattctgatatatgctacaacatggatgagccttgaaaacattatggtaagtgaagtaagccagaaataaagaacaaacattgtatgattctacttatatgtggtatatagaacagacaaattcatggagacaaaaatagaatagatgttaccaggtacagggagaggagcaaatgaggagttactgtttctatttgtgatcataaaaaagttctgaaaattaatagtggtgatagttgcaaaacaatgtgaatgtacttaatgccagtgaaccatacatataaacatagttaacatggtgaattttatgttatgtatattttaccacaactttttaaatgcaaaaaaacaaaacagagttttggaggtatgaggaatttgttttctatgccacttaccaacttgttagcaatgggttatttctccttaaaaactctgcttaagaaaaatataaattcaaacactttaccacaggtgacatatttttataattttagaagaattataggaagctccagaaaacagtcctggaggtaacacaaatcctgattgagtagtacttattactagcaggtctctctcttttttgagatggagtctcgctctgttgcccaggctggagtgcagtgccacggtcttggctcactgcaatctctgcctcctgggttcaagcaattctcctgcctcagcctcccaagtaggtgggattacaggtgcctgccaccatgcatggctaatttttgtacttttagcagagatgggctattacccatgttggccaggctgatttcgagctcctgacctcgtgatccgcctgcctaggactcccaaagcgctgggattacaagtgtgagccaccacacccggccagtctttcatttatttatttattcatttattttttaattaattttttgagacagagtctcactctgtcattcaagctggagtgcagtggcatgatcttggctcactgcaacttctgtctcctgggttcaaatgattctcctgcctcagcctctcaagtagctgggattacaaatgtgtgtgccaccatgcccggctaatttttgtatttttagtagagacaaggtttcaccatgttggctaggctggtcttgaacgcctgaccccaagcttcccaaagtgctgggattacaggcttgagccaccacacctggccttactagcagttgttattaaatgattatttaacactcctatacttatttctacaagacatccattgctattcaaaaaaatctaatttatctggagagaaaacaaggactccctttgttgtcccaaggacatgctatagggattggagtcctctgagactgtaactgaatcagctcagcagattactgcatttagcctcccttcctcttaacctggtagtgtcctacccgtctatgccaggggtaacaatctcaaatgcctaaagaagccagagccagacaaggaatataaatgaatgaagcaataggaacaaatctggcaagcaaaaaatgaaagctgtggcaacctggaatgcttctgccacacctacagaagcactgtcaattgatgccatgtgggaatgctattttttcattgttaccatgccttctgaattttcaaaagaggctagaaatttagatttttcaacaaactctaaaagctgagcaaaatgaatcagagaaccctaaatactttacaagccgccagtctgtgctttttgctccatgaacactccaagctacgaaggaaaatgacaggaaacaatacttcctagttattcatatctcattttggatctaaggactccaattccctgagagcaaggcagcaggtggcattcaagtcacgtaaaataaataagtcaaaggcataaactgaaaaggcaattttcttaatatctacttaacatataaaaagttaaaacctgacacttagagtatatgttaaaataacctaccaactttcaaaatgtcaggaactcagatgagtccatggtaactgcagaacactggaagaaaatattaagcagcaagaatataatttttaaaactctctgaagccaccctaaaaatcacatgattcacaacaaacctgttccctatgccatgacatgaaatgtctgttgtatcatcttggatcccatcctcttgatttttataactttggttgatataacagatatggatctgtaattctatatattaatttcccaaattccaatcgaaaatctctgtttgaaactgcctacctacttgattttttttttaattagggaaatattgctggaaaagaggagaaaatattttggaaaaagctgctttcttacagtttgacttagatacagaagtcaagaatagtacaggagtgaagctatttttctctttcccttgtcacaaaaagactagctacttctctccaaaggtgatctatttctggacaaggagagtcagaattcttccttaaacttaacccagttaacgtattcaccatcaatataatctccttctactacaaccaaaacaatatacagcaggatttaactaacattatgtgcttatgtactaggcactgagctaaactcatgtaatcctcactatcctacgaaataggtacttctatctgcaaagtagacacggttcctgccctcagaaggctattttctaatggcagaggcagacattaaacattctcaatgaagaatgtaccactgcatttatgatcacagtgagaaaggagatgaacaaggtgctaccaatgtacgtgaaaggaaaatatgaccttacccggggaggcatctctgtggaaataacattctatacagatcaaaggataagcaagttttaactaggcaaagtctccaggcagagagaagagtatgagaaaaggtcttgtgatggagtttgagttagagacaaaaaaagcaaatgcggccaacacagggagaataaggggaagcatgctgaatgaataggccatccagggctttgccatttacattagaagtctccaagccattcacattaaaagtctccaagagcaatagaaaatgctgaagttagaaaaaggggaagagaattatcagaattatgggcattttaatgcattttttaaattgaaagaacgtaaaagaagaaggtactgtctattgtctcactcccaccctgtcaatgtctatctgattttctccaccccactggtaatcaatcttagtcttacatagtacgcttatcctggtatgaatccacaggtgcatgtgcgcgcagacacacacacacccataaaacactttcctcctttcttacacaaaggatagcatgttatatgtactgtcctctacgctgttttttgtttgtttgtttgtttgtttgttttttgagacagagtctcactctgttacccaggctggagtgcagtggcacaacctcagcccactgcaacctctgcctcccaggttcaggtgattctctgcttcggcctcccaaatagctgggattacaggcacgtgccaccacgtccatctaatgtttgtatttttagtaaagatggggcttcaccatgttggccaggctggtctcaagctcctgacctcaggtgatctgcccgcctcagcctcccaaagtgctgagattacaggcactaattacaggcactaatgcctgggcatctaccctgttttttttcacttagtatatctattctttcttttgtttccaattgcacagcattccacggtttgatgtatctaccatgggttattttgttattacttttttgagacagagtcttatgccgcccaggctggagtgcagtggcatgatctcagctcactgcaacctctgccccctgggtttaagaaattctcctgcctcagcctcccaactatctgagattacaggcacgtgctaccatgcctggctaatttttgtattttttagtagagacagggttttgctatgttggccaggctggtctcaaactcctgacctcaaatgatccgcccacctcggcctcccaaagtgctgggattacaggcgtgagccactgcacccggcctaccatgggttatttaatgagtctcgtggatgagaagaaaaagcctacccaactgctactggattttgctgttacagacaatcttgtaagtgaggttgctgggtcaaatggtaagtgcatttgtacttttgacagacatggttagattctgcactcctaccaacaatgtatgacatcatttatgaaaactggacaaccaaatgagttaccaaacttttgagtttttaccaatgtgacaggtagaaaactgttttactgtagttttaatttgcatttcttttttattttaggtaaggttgcacataccttcacatgtttaagagccatctatacaattggccctccatgtttgtgggttctgcatccatggattcaaccaaccacagatcaaaaatattcagaaaaaaaatagatggttgtgtcagtactgggtatatacagacttttttcttgtcattattccctaaacaatatagttttacaacgatttaaatagcacttaaattgtattaattattataagtaatctggagataatttcaagtacacaggaggatgtgcaaaggttatacacaatactacttcattttatataacggaattgagcatctatggatgttagtattggggggtgggggatttctagaaccaatccctcactgatactgaggaataactgtacttcttcttcttctttttttttttttttttttttttgagacagagttttgctcttgttgcccaagctgcagtgcaatggcatgatcttggctcactgcaacctccgcctcccaggttcaagcgattctcctgcctcagtctcctgagtagctgcgattacaggcacacaccaccacgcccggctaatttttttgtatttttagtagaaacgggggtttcaccatgttagcaggctggtctcgaactcctgacctcaggtgatccacctgcctcagccttccaaagtgctgggattacaggcgtcagccaccgcgcctggcaactgtacttctttttctgtcaaactatctgttcatgtcctttgctcttttttttttttttttttttttttgagacggagtctcactctgtcgcccaggctgcagtgcagtggtgtgatcttggctcactgcaacctccacctccgggttcaagcgattctcctgcctcagcctcccaagtagctgggagtacaggcacccgccaccatgcccagctaatttcttatatttttagtagagacgaggtttcatcatgttggccaggctggtcttgaacttttgacctcaggtgatccacctgcctcggcctcccaaagtgctgggattacaggtgtgaaacactgtgcccagccctttgcccatttttctataatgtttttatgagcatgtgctaactttccttctctccatttatacaactgtcggcaacataagcgtcaattgttttaaaaactgtatttctcttttgactttccttatggtagttttttatcacagagatttttaaaggcaaatttaccaatcttttgacttccagattttgagtcataattttagaaaggctttataattctaaggttataattaaattctcctctggtttcatttttttatatttaaatctctgacccatgtaaaatgtatctgagtatacaacataaaggatctaatgttctctttttccaggtggcttcaaagttgtaccaataccattattagagtccatccttactcccactgatatgagatactgctttttaccatatcctaggttgttatattttctaatctatttctgaattttaatttctgccctattaggctgtctatccatgcaccaaataccttactttaattgaagctttagcttatgttttaatatcaggaaggtcaagtcttcatttgtctttcaagatgtttcagacttcttctctttcaaagtttttcagaatttagtttattacagtttttgtagtattttttattaggatcacttcaatttgtaaattaagtaagaaagaattgacactttatcatgagtctcaatttcccaattaagaacatggtatgagggccaggtgtggtggctcacacctataatcccagcacttttgggagaccaaggtgagaggattgttgaggtcaggagttcagtaccagcctgagcaacatagcaagactctacaaaaaataagaaatttagccaggcattgtggtacatgcctgtagtcccagctacctgggaggctgaggtgggagaatttcttaagctcgggagatcagggctgcagtgagccatgattatgccactgtacttcacctggtgacagagcaatggatgatcttggctcactgcaacctctgtctcctgggttcaaaggattctcctgcctcagcctcccaagtagctgggattacagatgtgtgccaccatgcccggctaatttttgtatttttagtagagacaaggtttcaccatgttggccaggctgatcttgaacgcctgaccccaagtgatccactcacctcagcctcccaaagtgctgggattacaggcgtgatacaggaatgcatagaaaaacaaagaacatggtactttttttatgcattcacgtctacttttgtgttcttcaggaatgtaaagagtggattgaaaagaggataggtaggtgaggttaggctagggaagactgtggcaattgaagaatatgtatgggataaactggagagagaatagagtgaagagagcgattcaacatttaatcacctggataggcctgccacagaggcagaaaatgaattctacaaagttagaaagaaaacaaaaagaaaagtattttttaagaaaaaagaaactgtcaaaagtacaattaagatgaagactaaaataaatacattaggtttagtgatatggaagtcattagtgatcatagtaagatctattttgggagaattatgtggctggaagccaaagtgggacttacattccagttaggccaaatagggctatctggctttaatttgtttctaaaagggtcttcctaaaggtcaaaatgccactgatttcagagtataactgtacagtaattattcctaaaatggagttcaaacacactctcagaaggaggttcttgaataattcacacaaagaatgcacagatccagaaaatactgccaatacaaggaaatatcagaaaccagactaggaagtaacagctagagagccaagggagtggcaaacatgaagtacattttctccaaagcaaactaggctataacttcagaaaaggatttggcttggcattagcccctgcaagtatacatacattcttaagcacagccagagagccagataaaataggtggctgcctaaactggatgccaaaataaggctctagctgctcagaaatacttccttctgcatcttgtcaagatacccttctctccttctctcaatctgaattcaaaatcctaattgtggtttctcttttgagatagtcccaacagaagcatatgggcttccccagcaggaaagtaaaggtattcaaggtatccccagtccttgttaacattcacaaaaaggataacacatagcatttagccacaaggagacagcaagaagggttaggaaacagaggcatcaattaaagtagtgacaatacattgatctgagccaaactggggctgaacatactaaaaggagaatgtcccattggaaattccagaaacctgggactgtgtgaaggtagagaatcacagggaattggggcatggcactcaaggggcataatcatagaatctcaactcaatgagtgaggcttagatgtaatctagttcagaaaattagaaaggtgatattattatatcacaattttaccactcatatttgaacctccacctccgggttcaagctaggaatctccaatggaagtaattaacagagcacatcataggttaaaaaaaatttttttttttattttagttccttcagaattctttaggacagaaagaactcctaagcccacctaagctggtgtgcatgcccaaaccaatttccaatgtggaaaaatagtgaaatagaccaatatctttttacctcccattttaacacaatttggaacaaaaaaaatttttttttgttaatcatagcactaaaatgcagaagttccaggtcccttctactacttaccagctacagattataggcacagacagcattataccaaaagtactagtaaggcctcttctaggtgtaagatccttgttcataaaaaacagatactctcacatcaggattactgtctcctttggttgctaagacaccaagcagaatcagtagattcaactaaaatcactgaaaaagaggtagaggagaaggaaaaaagggtgtctgaaatagagaaggcaattaacaactcatttattgtggctccatctagaaggttggatatatatttaagttgttctacagttttgtatccctacacctacaccttagctctacttcaatgtccacctaaagtcatattcaaaaagatttgcatcaactgggaaaatgtaatgcttccgacttccaaattactctgtggaagtagtgccacaggttgttccttctgctatcagtcttaagtggtggaattatgaaaaggtactgtatcagagaactgcattcacttagtaaaatgtactcccaggtatcgattctctgcaggaggttgtttcagaagaaaggaacaggggttggctagctggtttcttagtttaatttacataccttctttttagaaccagagggaagtaacaggggatattaaaggatgtgatagctattcctgagggcaatgtttgtatttctttatagaattagaattgtgctagttcttaccagggaagcagggaacaaattatgtattagtacattttgccgaaactttattctatttactgttatttggggaaaatgtattttattcctatggtaaaacgacagaactctgttcccaggcatgtgtctaatcctttttttcaaggaaaaaaatttgtaagcacagtattccaacttacagcaggcacgatggggacccatgagccagagaagatgggaaacaaacaggaaagagactcggcacagacatttgagggtaataaatatgatagcaatctagaagatgaacagttcatgttgtttatgattacaggctgattattcctctaagtgcaaaggctatccaataagtcatatccgggttgatttgttagcaaggtactttcaccagataataaattagaatgtaattaaagtgtattctgcctgtttatcattgactaagatagcttactataattctcaattatttgcatgaacacataacatgacagcatggtaagtaaaccttctggcaaagggcaacaaacatcttaggactgtgctaaaattgctagatttcttctccagtcctttaaaaaaactgtttccaattttgataaagtatgtaaatagaacaaattaatctggcacttgctttggtagagtaagtcacagagctagatctagactcacaagtcccgaaacttcttagcttgctagcaatttgctaaaggcagagactaaaccattaaagaaataaaacagaactgggtatttaccacagacctttattaggtagaaaaacttaactgtagagaaaatagaagaactacaaaaaaaaaaagatgtcaacatgtaaatttaaaaattggatttcaaaaagcacttatctgggcgggtgcagtgactcacacctgtattcctagcactttgggaggtggaggcgggtggattgcttgagcccagaagtttgaggccagcctgggcaatacagcgagacccccgtctctatttaatttttataaaaaataaaaatttttttaaagaagcacttacagcatataagacaataatttcactatataatgtctcctaaggattaataagaaacaagaccacaagacatatgtaaacaagacatacaaagataaacaaataaatagaaacataatgttcaaataaattacatgtagctcagggtaacttttttcacctgattagcaaaaatctttctaaaatgataatgaccaatattggcaaagatatagtgatactagtactctcatacatgctgatagtgttacaaattggttagaactcctcaaaaatgcaatctggcagtgaatttaaacactaaaaaatgtttataattttagcttagtacatccacatcatggaatctatctaataaacaaaaatattggccaggtacagtgactcacgcctgtaatcccagcacttggggaggccgaggcagctggatcacttgaggtgaggaatttgagaccagtctagccaacatggtgaaaccccatctctactaaaaatacaaaaaattagctgggcacggtggcgcagcctgtagtcccagctactcaggaggctgaagcaggagaatcgcttgaacccaggaggcagaggttgcagttgagctgagatcatgccattgcactccagcctgggcaaaagagtgagaccctatcttcaaaaaaattaataataatacacacacacacacacacacacacacacacacacacatatatacacctatcacagcttgatcaataataagaatccaaaacaacataaacattcaacagggtaaaggtatgtgtaatacaagacaataaaatatataatcacagatacaacattatacagcaatttaaaatgacagttaagaagattaagtggaaaaggatagaaaatcatatttaccatgattatatttaaataaaaatatgcatattaaaaaagactaggaaggaaaatgtcaaagtgacaatcattgtgttagggtagtatggcaggctgaataattggccctcaaagacatccccatcctcaaccccagaaccagtgcttgttactttatgtgataagaggaactctgcaggtatgattaagttaaagatctcaagatgggaggattatcctggatggacccaacataaccacaggggtgctcaaaagaggaaggcaggagggtcagattgagaggagatgtgaggacagagcaaagagtgatgaggtacaagtcaaaggatgcaggcagcctctagtggttgaaaaaggcaaggaacagatcctctctagaacctccagaaggaacacagctctgcctgcagccttattttagccccataagaccatttcagatttctgacctccagaacacaagttaataaacttgtaatacagttgtgttgtttggttgggtgtggtggctcacgcctgtaatcccagcactttgggaggccaaggcaggtggatcatttgaggtcaggagttcgagaccatcctgggaaacatgatgataccccgcatctgccaaaaatacaaaaaaaattagccgggtgtggtggcaggcacctgtagtcccagctactcgggaggctgaggcaggagaatcgcttgaacctgggaggaggtggctgcagtgagccgagattgcgccactgcactccaacctgggcaacacagcaagactctgtctcaaaacaaacaaacaaacaacaaaataaaaataaaggtgtgttgtttttagccactagcttcgtgatcatttgttacagcagcaataggaaactaatatagatggtaagactgacctttctaaactttctgtaatatttcatatcaattctattgttgcatgctaattttaaaaattagataaaatttaagtctagatgaaaacatattttgcttcagtggttctcaactctagttgtatattagcatcaagtagttagcttaaaaaaaaaaacaaaaagagtacaaatgtcatgccttctcctgtccccagagattttgatttgatttttgtgaggctcaaatatcattttttttaacccacatactaatgtgcagccagcgttgagaaccactgctctagtatagcaactcataaatgacgagtttccctaggccaaagcagaaatggatatcaatctaaaaccacatttgtctcaaaaatgctacaaatgaaaacactcagtgatagtctatattagtttaaatttagcactgagagttgcatcccagtttaactgactttgtcaaaggaagagaaaaaataaaactctttattctacttcttcaatgttttttatttgtggcatttaagacttcagagatatagtgctccaagaaaaaggtccttattaggatctacattcaaattagagcagtacacaagaattgtgtttcctttgcttacctactgacaactgaccttatgataatactactaaaattatgtaagatatttagtctttgaatttttacagtatgttttagaaatggtatagactagccaagagaaataatccatcaaattctctgataatgtgttctttagaatcacattttccctctactgtattttccaggtatcaaacttgtaaacacacaaacacacacacacatacttcagtatgtttgtgagcaaatgtataacttaaagttttcaaatgtgagattctaagctataaactactgacagtcttatgcatcttttggttaacttagcatcacctcatattctttcagcagcaaaatccatatatgaaaagcatcgttatcaaccaagtgtgtccaaagattgatctccatagcaactgtaactctgccacatgtagtgtataaggcatcagagttaacaccacatgcacacaaagtgttggtattatgtagtccagactggttgctgtagaaacctaaaccgaagtccctgacaacagtggataaaatgaaaacaacaacagaatggtccttaagaacttacctatctactcttctgctttcaagcaaagccatcctaaatgctctattgatattatttatacttaaaactgatagcactaaaggaaaataattttaaatgatgttatatctttaggaatcacttcctattccataaaaaattctccttcccaccctctgctcaactggatgttcagaagctcactccaataaagtaccgtcaccttcttctagcctcagccagaaccagtcccacacagacaagctggagaggtgctagccttttgctgcgactaccacaactatgatagatacagacaagcttattctaaaacaagtttgaaaaagaagaaaagtaggaagaatcactctgccttatattgtctcactacatcgctatcataatcaagacagtatagtattggcagaagaaaagacaaatagaccaatggaacagagaatccagaagtggataaatacaaatacaccaactgatttttcacaaaggtacaaaagtagttcaatggagggaaaatagtcttttcaacaaatcatgctggaacaactggacatccatgggcaaaaataaaaaataaaatagaagcttgacttaaaacgcacaccgcatacaaagatcaatgcaaaaaggatcacggatttatgtaaaatgtgaaccacagaactataaaacttttagaagagaacataggagaacatctttgggacctagggctaggaaaagagttctcagacatcacatcaaaaacccaatctataaaagaaaaaaaaaaaaccagtaactggatgtcatcaaaatttaaaacttttactctgcaaaggactccattaacaagataaaaagatgagccacatactagaagaaaatatttgcaaattttatatccaaaggacttctatccagaatatgtaaagaattctctaaactccgcagtaaggaaacaaacagtctatttgaaaataggcaaaaagacttgagtattcatcttaccaatgaggatgtaagtatggcaaatcagcacatgaaaaaacgttcgacatcattaggcattaaggaaattaaagctaagatgagatattactacacatctattagaatggctaaaataaaaaatactgacaataccaaatgctaacaaaggatatggagaaactagatttctcataccttgccagtggaaatgtaaaatagtacagctactctggaaaacaatttggcaatttcttatgaaattgaacatacacttaccatacaacccaacaatcacactcccaagcttttatcttaaagaaacaaaaacatgttcacataatcacctatacatgaatgttcagagcagctttatttgtaacagcccaaactagaaacaacccaaatgtttatggtaaatggatatataaactatggtacattcatacaatgagatattaattagcagtaaaagggaacaaactactggcatacacaacttaggtggatcacaaggacattacgctgagtgaaaactgtcaatctcaaaaggttacgtactatatgactccatttctataacatttcaaaagacaaaaacataaaaatgaacagatcaggcagtgctcaaggttaggaaaggaggaaaattcctggtgctgcactttgtagtctcaaagtgcaacaccaggaattttcttcatagcgatggaacagtcctatatcttgatgatggtagttacaaaaatctatatacgtgataaaatttcacagaacacacacacacacacacacacacacacaaacgaatgcatgtaaaaacgagtgaaagccaaataaggtttgtagtttagttggcagtactgtaccaatgccaatttcctggtttaaataatgttctatacttatgcaagatgttaccacggggaaagctggatgatggctaaaaggacctctctgtacaatttttataacttcctgtaagtcagtaattatttcaaaataaaaaggttaaaaaaaacttgtcagcaaaaacctataaaattttaaaagtaaaaaaaaaaaaaaaacttaaaacatttgacaaaaagacccttaatatatgaagagctcttctatgtcaataggagatagtgcaaataaaaataaggaaagaatataactaggcaactcaacaaagaaataaaattggccaaccacataacaaaaaagactcaatctcattagtattcaaatactaatattagtattaatattcaacatacaagaagacttttataacatctctcaagttggcaaaaattatcaatatccaaggttagtaagaacaaggaaaaacaggcactcccatataccatggacagaaattaatgtatgaaaatatttccaatagaagatattcatactcttaatcccaaaaagtcaatatttaggaaggtatcctaaggaaataatcaaacaagtgtgcaatgacatacatgcaaattccatcacagtactatctataatagtgaagaattcaggagaaaaacatttaaaaaaaagaggataattaactgtattatggaatattcattataatgaaatatcacgtagttgttaaaattatgtttattaattttaaaagcaattctctatatactgttgagagagaaaagtaacaaaaatatacacatgtgataaacctatttttatggccatgcaggctatacaccaaaatattaacactaggtatctctgagtaattaagactagggtaacttttcgttatatatttctgtattgtccgacaggagcatgttttatacaaaaataaaattaattttcattttttaaattaaacaatacatactaagctaatgagcgttcttttaactggagatttcatatattacgatgctaaaagcactacataattttttttacttccatagaaaaaataaaactaccctgcctgatatagtaacatctgctttttctttatgactcctccaggttcctgaaaagatattcatttttagtttaaaaacaaacaaaaaaagcctgaccagggtggctttaaagaaaaaaatccatgcaacccaaggactatgtatgcttgctcatcatgaagttgataatctctgcatctctgttatatctagttgtaaatggcaatgagtattgttttaggtattagtaaactgttaatttattaataacatattgacaagtgtactctccatttgtcatagaagaaagctggacagcaaaaagggaaaagagaataaaatgacaagaatgataataatatcttccttaatgtgatcttgggaaaaaaagaatttcatttctgaggataaggaaggaggacagcatataggaaataatttcctttttacattggtaacttgtatcaatatcagaatctctgaaagcttatttgatagtctgtggtaagtaaggttttattgttcagttggaaaataaagtttctccagcagagacacatggcttctttgtctgttatttccctcagttaaatacttgaaatgtccaagtttaataataaaatattgttgctttcatagtgaatttcctggattatatcactctcccgaagcccttccagcatttaaagaagttttttgtttttgttttacagacctgaattaagaggacttacaatatgctgaaatcatcaagaagctttcttaggctcattaagttaaaattctcccacatgattaactgctgattttgactcaaaagtaacataatactaccactcctcttcctgatttccacacttggcattccaggtaaaaggcagagcagaaacaacttcttcctattttccatctatacaattctacccatttccagcagcttcttaaaatttttcttcttccataaagcctttggtttagccagcccacagtgttctaccctgaagtcctgtagcacttagctaaacacttcatttagcaattactaacaattatgattatttttatcttgcatctttttttttttttttttttttttgggacagggtctcactctgtcacccaggctggattgcagtggtgcaatcacggctcactgcagccttgacctcctgggcccaagtgatcctcccatgacagcatctcaagtaactgggaccataggcgagcattaccacatccggctaatttctttaattttttatttttatagagataggatctccctatgttgcccaggctggtatcaaactcctgggctcaagtgatcctcccacctcagcctcccaaagtgctggtattcaggcataagccaccacactggaccttgtatcattaaactgcatcattatttgcatctagtttccccaagttctcttgcaggaaccttttttacctcaacatatcccttattgtgctttaatacacagtagtgagtcaataaacatttgttgatcaactataacacaagtaaacctttcagttccactcttatttgatactaatttttttttcaacacttagctattatttctcctacctatcctttgtcttacttacaaggacaaaactacaaaggagaggctgaagatacaggctgtgtaaggcattgcattctctttgtcttcctgcagcaaaaattatttaaaatgtgaaaagagaataaaatgaattgtatacctttggtatatgtctttcaaagtgaaacgaccatcatttaacaagaaattagagacctcattggagaatatgctaagggaaaatccaagggaataatactcatggattaatgaactgattccttctcaaaggatatgaacaactccatcagtctttgatatggtttggctgtgtccccacccaaatttcatcttgaattgtaattcccacaattcccatgtgccgtgggaggaacccagtgggaggtgattgaatcatgggggtgggtctttcctgcacagttcttgtgatagtgaatgaatctcacgagatctgatggttttaaaaacgggagtttccttgtacaagatctctttctttgcctgccaccatccatgtacgatgtgccttgctcctcattgccttccaccatgattgtgagtcctccccagccatgtggaactgtaagtccattaaacctctttttcttcccagtcttgggtatgttttatcagcagcataaaaacagacatacagtaaattggtaccagtagagtggagcattgctgaatgtatacccaaaaatgtgaaagtaactttggaactgggtaacaggcagaggttggaagtttggagggctcagaagaagacaggaaaatgtgagaaagtttggaacttcctagagacttgttgaatggctttgacaaaaatgctgacagtgatatgaacaataagatccaggctgaggtggtctcagatggagatgaggaacttgttgggaaccggagcaaaggtaattcttgttatgttttagcaaagagactagagacttgtggaactgtgaactagagagagatgatttagggtatcttgtagaagaaatttataagcagcaaagcattcaagggatgacttgggtgctgttaaacggattcagttttaaaagggaaactgggcataaaagtttggaaaatttgcagcctgacaatgcaattgaaaagaaaatcccattttcctcacacctgtaatcccagcactttgggaggccgaggtgggtggatcacgaggtcaggaaatcgagaccatcctggctaacatggtgaaaccctgtctctactaaaaatacaaaaaattagctgggcgtggtggcaggcacctgtagtcccagctactcgggaggctgaggcaggagaatggcgtgagcctgggaggtggagcttgcagtgagccgagattgcgccactgcactccagcctgggcgacagagcgagacttcgtctcgaaaaaaaaaaaaaaagaaaatcccattttctggggagaaattcaagctgcagaaatttgcacatgtaacaaggagccaaatgttaatcaccaagacaatgggaaaaatgtctccaggacatgtcagagacctttgcagcagcccctcccatcacaggcctggaggtttaggaggaaaaaatgattttatggaccaggcccagggtccctccgctgtgtagtctagggacttggtcccctgcatcccagctgctccagccatggctgaaaggggccaacataaagcttgagctgtggcttcagagggtgcaagccccaagttttggcagcttccacacggtgttgagcctttgagtgtatagaagtcaagaaccggggtttgggaacgtctgcctagatttcagaggatgtatggaaatgcctggatgcctaggcagaagtttgctgcaggggcggagccctcatggagaacctctggtagggcactgcagaagggaaatgtagggttggagcctccacaaaaagtccctactggggcaccgtttagtggagctgtgagaagagggccaccattctccagaccccagaacggtagatccactgacagcttgtaccgtgtgcccagaaaagctgcagccactcaacaccagcccatgaaagcagccaagagggtggctgtaccctgcaaagccacaggggcagagctgcccaagaccatgggagcccaccctttgcatcagcgtgacctgaatgcaagacatggagtcaaaggagattattttggagttttacgatatgactgccctgcttgattttggacttgcatgaggcctgtagcccctttgttttggccaatttctcccatttgaaacagctgtacttacccaatgcctgtacccccattgtatctgggaagtaactttcttttgattttacaggttcatagatggaagtgacttaagatgagttactggactgtgggcttttgagttaatgctgaaatgagttaagactttgtgggactgctggaaaggcataattggttttgaaatgtgaggacatgagatttaggagggaccaggggcggaatgatatggtttggctgtgtctccaccctaatctcatcttgaattctagctcccataattcccatgtgttgtgggaggaacccaatgagaggtgattgaattatggggatgggtctttcctgtgctgttcttgtgacagtgaatgagtctcacgagatctgatgttttaaaaacgggagtttacctgcacaatctctttttgcctgctgccatccatgtaggctatccacaaaccattttttgtgacttgctcctccctgcctaacgccatgatcatgaggcctccccagtcatgtggaactgtaagtccattacatctttttttcttcccagtctcgggtatgtctttatcagcagcatgaaaattgactaatagagtcttgtccctgatacttccaaaatctgcactcatgatttgagagagcctttatgaaatcaaacatatttttaccaatcatgaattctatctatctaaaaggacatttaagtgccagcaaagagttttataattagaaatccattcttttaagaatagctatattacctaaataattccagatattttgttttggtttttggttaaggggtgggagcaggtgggcagaaaccaaaatgagaactctccctattgtttgtcattccatcctaaatgagccctttcttatatttccagaggtttcttatatttttggaggttccagaatttaagtttatgacactcatttgtaatgcatatgagtatttagattggattgttactttaaaaaaaatggtttgtagatagcctacgtctacattatttctacaaatcccaaccatatcaaactggagttgcttccagcatttataatgaatttaccaacaatatgaggccctatttagagacagctgtttctgagagaggaacaaattttggattgacaaatttcacattttttacagaggttgtgcaccagctgattagaatttgttctgaaattctatctatatctataatgtttaaaactaatatattttcatagtgtatataagatacagtcaaaattttctgaactattccaattactcactagtacactgcagagactcataaggaattttatattgtccttcactctgtctttaaggtgcaagtcaatcccatggaagatttcaaaataaaaggatgcaacagcatcttgtagtaatccattgctaacaagtggtatagcttcaaaaagcttccccacttaattttaatcagcacttgctacaatttaagtgtattcttttgtgctctgtttttagaaaaagttgatcactatcttcaaccatgatgttctatgctttgaagaatgatacacaagatgaatgccgtgactaaggcaaaggtcaggacagggcaaaactctctggttaggcaaaattttattccattccttcaattctataagtacttattgaaggctttctgtatcaagtatatgctgggcaacagaaacataaaagagaaaatcagaccagacgcagtggctcatacctgtaatcccagcactttgggaagctgaggcaggaagatcacttgaagccaggagatcaagaccatccttggcaatatagtgaaactcccccatctttacaaaaagaaatttttttttaattatctgggtatagtagtgtacacctatagtcccagctactccagaggctgaggtgggagtattgcttgagctgaggagtctgaggctgttgtgagctgtgactacgctacagcactccaacctgggcaacagagcaagattcctgtcattcattcattcataattaaataaatagaaaatcatctctttcaaaaagttcacagtcatgggaacacttatacctaaattagaggtccaggccagttcatccatgaagcagcaactataactgaagcacgccaaattgtggaatggagaacatatgcccagtctaaaggatgcagccactacctgacaccagcactcccatgctctgggagaatgcaaactcagtggtgtcacagcttctgattttctgagaagacagaaactttgaggaatgaacatttaacctagagaaatcagggaatgcttagcaaaagagctaacatttgaatcgagtcctataaaggttacgcagagtgtactaggtgtgaatgcagatgccttatttcctgtggctacagcttagggtggaaagtggggagtggcaagataagcaactagagaggaaagaagccatgcacaagctaaactctatgcacagaacacaagaacttgttgaagaagttactctataatacaacatacaagagcagaatttatctgtctgcagaaaactctaccaaactcccatacagtgagatttcaaggtttggtagacatacaaagaggcaggtatcttgcttttagtccataaagctagactggacactactgtatctaaacactctttggcctcgaactattgagacatctaaatgcctgtatggttccagtagcagcagtgggtacataaacacatagcggccatgaagaagaatatactaaacctagggtgggcgcggtggctcacacctgtaatctctgcacgctgggaggccaaggcagccagatcatctgaggtcgggagtttgagaccagcctgaccaacatggagaaaccctgtctctactaaaaatacaaaattagctgggcgtggtggtgcatgcctgtaatcccagctacttcggaggctgaggcaggagaatcacttgaaatcgggaggcggaggttgcagtgagccaagatcgcgccattgcactccagcctgggcaacaagagcaaaacttagtctcaaaaaaaaaaaaaaaaaatatatatatatatatatatatatatatatatatatacaccaaacccagaaagaaagattttgggagatctgtcatccccaaatgtctcccctttactcttgacaagggtaataccttattcattgctaaaattacttagcatatacaagacctcttgacatatattattctcacccacctaagacaccttcagctccctattttctattttgtgggggtttataactcacacatccactgtagccaattgtattcatattttgcactctttttttgtatattaaaccactttaacttcaaaagttctaaaacctaggccgggcacagtggctcacgcctgtaatcccaacactttgggaggccaaggtgggtggaccactcaaagccaggaggtcaagactagcctggcgaacacgacaacaccctgtctctactaaaaatacaaaaagtagccaggcgtggtggcgtgcatctataatctcagctactcagaaggctgaggcacaataatcactcgaacccgggaggtagaggttgcagtgggccaagattgtgccactgcactccagcctgggtgacacagcaagattctatctcaaaaaaaataaaaataaaatttaaaaaggaccgggcatggtggctcacatctgtaatcccagcactttgggtggccaaagcaagtggatcacctgaggtcaggagttccagaccagcctggccacatggtgaaaccccatctctactaaaaatacaaaaattagccaagcgtggtagtgggtgcctgtaatcccagctactcaggaggctgaggttggagaattgcttgaacctgggaggcggaggttgcggtgagccaagactgcaccactgcactccagcctgggagacaagagagaaactccgtctcagaaaaaaaaaaagaaaaaagttctaaaatctaattcagggccacatgttaaccagcaccagcaatttcttcatcttcctaatcttcctaacccattagtcaatcttattttattgtaattcaaaaaaattaatcgatattttgctccagaaaggatgattagttttgccaaggaaatttgctattctccaggtaggaaggaggaaagaaaatcacgttgggttctgtcacctaagcctttcattcagtgagcctcacaacaagataggtattattattccccttttcaccaatgggaaaactgaagttctgagtagttaacttgctcaaatagcaggtagtaaatgactgatgtctgggctaaagccagacctctttggaagacacagcttctaaaactaacttcttcccactattccacatagctttaactgtcaccctttttcttttccttttttcttgagacagggtctcactctgctgcctaggctggagtgcagtagcgcaatcatggctcactacagcctccacttcccaggcttaagttatcctcccacctcagcctcctgagttgggactacaggtgcatgccaccatgcccggctaatttttgtatttttagtagagacaaggtcttgccacattgcccaggctgatcttgaactctgggctcatgcgaacctgctgctttggaccctcaaagtgctgggattacaggcgtgagccactacacccagccacccgttattatttctaataacaatcataatactgcacttctaccttatatttgtacagtacagcatacctttcaaatcactttcatctataatatttttgtgggttcctaaaactatttttcaagaaaacttgggcaaagaaaaaaaaagatgactagcctaagatcacagagaaatgattactgagtacaaataatagttaataacagtagctatatttattgaacagttaatctaaacattttacaatctgttgtctcatgtaatcctcattacaatcctgtgagacagcaatgacaacaatatgacctcttttacagatgagataacaaggcttaaggaattctgtagttcacatagctaggaaatggcagtcttggaattaaaattcaggtactagtaggctcacaaatctattttcttatctacagcatcatacagaactgcttccctaaactgcagtgctctttatagaatattatgcatttactataattaagttaaactaaaattagttagaattgtgaactgaaattgctatcagtctgatttccaaacctactactgaatgaaagtggtggaagaagcaaacaggtggcagaataatatctagcaggaatttaaaagaaatttttcactgggtaatcaacacatagataatcaaaaacacaatataatttggggggaaagtaaaccatcaacatctcaggattatcctctttggatcaagagacattaccctgatcatttaacaaatgagcccactattcaaacatacattcaaaagcaaaaacattctatttttcattttatttttagttgacacataatttatgggatattgatgcatgatatttctcaatacatgcatacaatgtgcaatgatcaagtcagtgtaattagcataaccatcaccttaagcatttctttgggtagtgaacattcaaaatcctctctttggccaggtacggtggctcatgcctgtgatccaagcactttgggaggccaaggcaggcggatcacttgaggccaggagtttgagaccagcctagccaacaaaatacagaaatacaaaaattagccaggcgtggtggtgcacgcctgtggctgaggcatgacaatcgcttgaacccaggaggtggaggttgcagtgagccaagattgtgtcattgcactccagcctgggcgactgagggagacactgtctcaaaaacaaaaacaaaaacaaacaaaaaaaatcctctcttctagctttttgaaaatattcactaaattactgttaaccatattcaccctacaatgccacagacactagaacttattcttcccatctagttgtaactttgtatctgttaaccaatctctccctatccttccctcccctctacctttccctaccaccccaataaccacaattctaattctttaagctcaactttttccttagctcccacatataagtgggacatgtggtatgtatctttctgttctgacttatttcacaacataatgtcctccaggaaaaaaatttttttttaactcatcttatgaaatagtaaaaatcatccaggatggaaaagctccaccccagttttttcctacgttgaccgggtatactcatattcgtaagtatttttaaagttatgttaaaatatccatactacccaaaagcaacctacagattcaatgcaacattcttcacagaaacagaaaaaaaaaaaccctaaaatttatatggaaccacaaaagacccaaatagccaaggccatcctgaccaaaaggacaaaacagaggaatcacattactggcttcaaattatactacagagttattgtaaccaaaacagcatggtactggcataaaaacagacacattaaccaatggaacagaatagagaacccagaaataaattcatacatctacagtgaactcactgttcaacaaaggtgccaagaacatgcattggggaaaggacagtctcttcaataagtagtgctgggaaaactggatatccatatgcaaaagaatgaaaccagacctttatctctcactatacacaaaaatcaaattaaaatggattaaagacttaaatctaagatttcaaactatgaaactactaaaagaaaatattgggcatactctccaggacacttgcctgggcaaagattacttgaataatgtcccaaaaagcacaggcaaccaaagcaaaaatggacaaatgggatcacatcaaattaaaaagcttttgcaaagaaaaggaaacagtcaacaaagtgaaaagacaacccacagaatgggagaaaatatttgcaaactctatccatctggcaaaggattaataacaagaatatacaaggggctcaaacaacttgaagggaaaaataatcgaataatttgatcttaaagtgggcaaaagaagacattcaaacggcaaacaggtatatgaaaaggtgctcaacatcattgatcatcagagaaataaatgcaaatcaaaactacaacgagatatcatctcaccccagttaaaatggctttcatcaaaagataagcaataatgaatgctagtgagggtatagtgaaaagaggactctcatacacgactagtgggcatgtaaattagtacaaccattatggaaaacagtacgcaagttcctcaaaaactgaaaatagagataacttgtgatccagcaatccccctgctgggtatatgcccaaaagaaaggaaatcagtatactgaagagatagctatactcccatgtttactgcagcactgttcacaatagccaagatgtggaagcaacctaagtgtccatgaacagatgagtgcataaagcaaatgtggtacatatacacaatggagtatttattcagtcagaaaataaaatgagatcctgtcatttgcaacaacataaatggaactggaggacattaagtgaaataaaccaggccagaaagacaaacttcacatattcttactcatttgtgggaggtaaaaattaaaacaattgaacttatggaaacagagtagaatgatagttaccagaggctgggaagcatagtggcaggtgggtggtagggatggttaatgagtacaaaaatatcgttaaaatgaataaaatctagtatttgatagcacaacagtgtgactacatttaacaattatttactgtacattttaaaataattaaaagagtattactagaatgtttgtatcacaaagaaataacaaatgcttgaggtaacacataccccatttaccctgatgtgattactaggcattgtatgcgtgtatcaaaatacctccatatatatacgtgtgtgtgtgtatatatatacatatatacctccatttatactccataaatatacacacttactatgtactcataaaaattttttttaaagctcaacagtaaaagacaaacaaaaaatcagtttgattagggctgggcacagtgagtcatgtctgtaatctcagtactatgagaggccaaggcaggaggattggttgagcccaggagtttaagaccagcctgggcaacacagcaagatctcatctcttaaaaaaaaattaatctattagcccagtgtggtgttacacatctgtagtcctagctacacgggaggctgaggtgggaggatcacttgagaacaggagttcaatactgcagtgagctatgatcatgccaccatactgcagcctaggtggcagagcaacatactgcctcaaaacacacacacacacacacacacacacacacacacacacacacacacacacgattaaaatgacctcctttttgtgtactcataaaattgtaccatgcatactccattgtcatatagtcacacttgatttgaatcatggtcactacagaataaaaagtatgtgagaaaataaatattttaaaataatcaaaaatgcttttagcaaaagctttatatatactagagtagtagtcctgtgaaactaaatgacattccttttaaaaacacagtggcctaaaagacatagcctaaagttagagagagatgttaaagaaggtagatttgtgaaggtattattattctgaagataaatctcatttatttgtaatatcaacattttaacagacagaaatctcctgtcataaagcccctgtaattattaaacactgtcaagagctcgatcatgcaaattatcactgtttcaaaaattcaaaacatgactgctaagtttttagagtattcattagacctatctctagcatcacaatactggaaataaaatctttttaatttgctaaaaaaaatctttgaagcaaatgaaataatattccaaggagactccaggagaataattttttaaagctattttaaaacatttgttgaaacgaagttacagaacacaaaaattgcgaaaaaaaaatgaaaggttttcaagagcctttggtgagtcacaggaagaaaagcaaatccagctgcactccataaactaaagatttgtatttagaacttccaaaaaatattaaatcagaaacaactatctgatgtgttaactatgtgcccatttttaaaacctactctctagtatagctacttttgggaaaacattcattaaactcttcgtcaaaccacaaacacagatggatttttttggtaactaatgggcctctaaggtgtttttagaaaagggagacaaatcttggccctagagaataaagaagggacaattacagaatacaggattgatgaaaagcagttggcaatacagtagtaatgagcaacatgagaagagaaattatctgaatccaaattattatctaaacaaaaggaattattatagtacttaaaaacctataaccaatgtatcctcattcattgggctcaaaatgaagaacacagaccagttagaattcttcagccttaaataatatatgtaccctttttaaaggtaaaaattcagttactgagtactgccttaaataatttttattaaaatattatttaaatatgtacacatgtaaaagtgataaactctatttggttatacttcttatgtaactaaaaggagagatttgttaaaggatacaaaatttcagttgggaggagtaagttctagtgttctttatcactgtaggatgactatagttaacaataatgtattacatagtttcaaatagctaggagggtaagaacgttcccaacacaaagaagtgatgaatgtttgaaatgacagacatgctaattaccctgatctgatcatcatacattatatgtatcaaaacatcactatgtaccccatgaatatgtacagttattatttgtcaattaaaaaaataaagtacaaattgaaaacaaaatttattcaaattggcattaatttactacgacagatgatggtacttgactgatactaaattgctattcccaatatgaaatgggtgctgactgcctcagtgtgggttttttttttctttcttttgagacacagtcttgctctgtcactcaggctggaggagtgcagtggcatgctcatagctcactgcacccttcaactcctggcctcgagccattctcccacctcagcctcctgagcagttgagattacaggtgtgtgccatcgcactggtaattctttgaaataagggaagactatcatgaaaatgcattctctcaccccttttctctattcaaattacagttgtgaggctgggtgcagcggctcacacctgtaatcccagcacttttggaggccaaggtgggcagatcacttgaggccaggagtctaagaccagcagcctggccaacatggcgaaaccctgtctttactaaaaatacaaaaattaaccaggcaaggtggcgcacacctatagtcccagctactcaggaggctgaggtacaagaattgcttgagcctgagaggcagaggctatagtgagccaagatcgcaccactgcactccagcctaggagacagagtgagaccctgtctccaaaaaaaaaaaaaaaaaaaaaaaaaatttacagtcgtgccttgttatacatgggggattggttctaggacctcctcatttccacatataccaaaatccatgcatactcaagacccaaaatcagccctgtgggagcctgtgtattatgaaaaattggcctccctgcacacgagcttcacattcccctatgccccacctctggttgaaaaaaatctgcgtataagtagatagatctgcacagttctaacccattttgttcaaaggtcaactgtatatgaaattgttattcatgtaacatactgctcttatatctcctgattgaggccagaagattctttcactctcgacacaggaaacaggttggtgaaaagcacatgacaatcattactaatcactttactggctctagtttctagggctaaggatttctgtgagaaggactgctactgaaatggactccttgaactcagaaagcaatgagaggcacccagggaaaggtcgcatccaggtggtagtagttaactgacagaaacgaagtgggcatggtgatcctaacaggcagcaaggtggatatggaatattaggtcatctcaaactttgttgtgataggcagaaatccctgtctatatttaattagactcaataactcaaatcaacaggcaacccacttagatctgtttttattttttatttttattttttgagatggagtctcgctctgtcacccaggctggagtgcaatggcatgatctcagtttaccacaacttccacccccagggttcaagtgattctcctgcttcagcctcccaagtagctggaattacaagcatgcaccaccacaccggctaattttaatttttttctttgtatttttagtacaaagtttcgcatgttggccaggctggtctcgaactcttgatctgaagcaatctacgcgcctcggcctcccaaagtgctgggactacaggtgtgagccaccatgcccggcctgttttgatttaaataaccaaaaatgaacaaataactccaggtctagtgaacttgtctgagccactacagtagagagtcaggaactctcacccaaattcgagacccacggttccttgaatgaaggggaggccaaatcccttttggaaggttttatttccccccattggatctctggccatttacccaggtaatcaagagctggcaaaagggaaataccaaaacctctccaggattattacatactggctttgagctaacattaattcttaggaattaagaataccacaggttcatcagttggattgacaatttatgaggctcatgtataggagatgaagttctaattcaacctcttctcacaacagtcatcatgacaaagcccaagcacacctagttttcagatgttaccaaatactgcccacaatgactccctggttcagaaggaaggactattatggtaagaggtatgaagtggaagatgatcaaattccctttccttatgaaaattattgcatttctaaggggtgagttttctaaaatttataaaggaatagtgaaatgttattatgagacaaagacatactgcaagcaggcatactgccctcctccctccactttcttcctgtacagagaattgaaaagatgtgtccacctaaaatgatgttgtatttaatctggaaaagctgcaatgaatacaggtattgaaacaaggccatggcaatttcagcaagcaactgaagtaatgatttctttctgaaaaacagctcctggcttgctactaggatccagtgaaaacagaatagaacattaagtgaccatgcaacctagctgtccatcatgagttgttattggatgcatttaactctaaattccagcaagcccaaaatgagctgtgaaggcacaattaaattgcatatcagatcacttacattccttacaaccatattcctgctacatgccacctctccctcaaactacacctatggcttcatgagaagtgccctatgaccagcaagcttgcagaggggaaaatgcctctccctggttaaagaaagacctgagcattatgttacagctgcaagtgtaccactgttgcataacaactccattcaggggtgatcctgagaatcagctgagaggagaaagcctccttgtgagaagcacttacagtggtacgtatcattgttcactttacttgaaaatatgtggcctgaggtcagtatctacatggtaatttctggcatgtccaatagactggctgaataagcaggactggggaggagcatatttggatgactagtgacaaggtagtttgggaaaggaatatttagatacatttttgggaatgggaccagcacctgagaatatctgtgctccatgtgactgctcagcaaaattaccaccaagaagagagtactaataagtatatggacaaggtgactgttactgaaagagtgagccattttccttgcctagtcaattcagtacttggctaaatgttagtgttttgacagggacagtggctatacatgtgctcaacaacagggatttcctcccaccaaggctgagctggtggtctcactgctaagtgtccctatatggtacactcctccagttgagccatctacctcataagggatggactccagtgacccttttcatcctagagaggttagtaatttgtccttttcagaagagatatttattctgtatttggatgtgatttacctgtcatgttgctaccaacactaccatctgtggacttacctgtgtgccagtgtgatattccacttagtgccactgatgaataaaatcacttcccaacaaaagtgaggcaactggctggtaaccaagggcttctttgatcttaacatgtactctttgcatctttcagaagcagcaggctcacacaatggtgaaatagcctatgacaacatagacaaggttccagctaggatctattgctatagaacacagcttatgagccaaaccagcacttttccaactgggtactggacatggcacttctcacaactccagctaatgacctctcaaaattgtttccttcctctaagacagggagctactaaaggttttgtgcccagggaaagaatgcttccaccaggagatataaaaatggtgcctttgagctggaagctgagattgctacctggctcatcatgccagaaaaagcaaatgagaggcttaaatagagggatatatccgctacaaagagagtatctgaatactgtatacaggaggaagagaatgagtacaggtagaatgtaagaaatgctctggagtgcataataataaactataatgaaagactatttcatgtctatctaagctgggccaccaatggcttaggatgaagaaggtgtaacaacccatcaggcaaaggaccccacccagctgaagttatggtcataatctaaattctttatttggtattagtgattgtgacatgaaaatcaaagtaacattttaagcagtaagaagtgtattctttctcatgtaaaaagaagtctggaaatgggcaatacaaaactgtgttggaaattccacaaggctattatgttctttcttactctccagcccaccatccataaaatgtgtcactcaaaaatggcttctagagctccagccactacatcagcactcaaagcagcaagataaaagaagggagaatgaagggtagactcctctctttgaggaggctttctagaaattcaaatgcttctaccaacatttcttttggccagaaattagtcacacagtcacacccagcagtaagagaggctaagaaatgtaatctcttatacctgaataaattcagggttctctcaccaaagtggaaggggaagatgaaaattgagaaaggctgccgccagtctctgccatagcgtgtccacggttttttggtgtttcctctacctcattatttcctctgcactacatataagtgtgatggtagtggataaatttaccatttagcccacaggttgaagaatgtaagaattaggtcacaaaattagaagactgaacacaactcagaggtcctagacatgacaataagttatcttttttgtggaggtggtcagaatgactaatttcctcatttaaggtgggaattcttttaaattatctatacagtaagaaagggggcagaaggcagtaaattcaaggacagggtgccctgctcagaatccattccccttttggcctgtaacacatttcacttttcaattagggaaattcttttcccttattctgtgaggtctaagcaggcatgaaatacagtagcttactccccagctgaccacaggggtggccaacactcaagcaggctcaaacctagtacaccattcacccatgaaggaaatgatctatttggcaataaagaccaaacagaccccctctcacaggactttgaatcttgagcagccatccaaggataaaaggcagcctgagccaaaacttcctgacagcagtgctgtagtctagagaaactgtctgtaaattcctgctactgactgccctagagcgtccccagttctcattcttcctaaggcctgattagctcctccttgcctaagtaatccaaaatcaatttcttggctaggcgcggtggctcacacctgtaatcccaacactttgggaggccaaagcaggcaggtcacctgagatcaggagttcaagaccagcctgaccaacatggtaaaaccctatctctactaaaaatacaaaaattagccaggcatggtggcacatgcctataatcccagctactcgggaggctgaggcaggagaatcactcgaatccaggaggcagaggtcgcactgagctgagatcacaccactgcactccagcctgggcaacagagcaagactccatctcaaaacaaaaacaaaaaaacaaaaaacaaaaaacaaaagcaatttctatgcttgcaactaaacaatgctgagataattctatacttcctccctgagagatgagaaacccctatggctttaaatctcacctgtattgagtacttccaactctagccttagtgtttacctcctgtaggaggacctaacccattcctaacttcagtttggacatttccacttgctgcaaatacttcacgttcaacaggtctacaaaatttccccctacactctacacccaacatacttctgctagtatctcaacatactcaattgctcagcttattcttcttctgttctttcactctcacaattatcaagtctgcaattaccaacctcacttcacaaatgtagcttgaatccagtctttccacttcatctccatcactactgcctaagtttataactcaccatcatcattcctctatccgcaagaacatctcaattttcaatgtttaaatcatctcgttgagaccttttgccactctattgtttatgtcttcattttatttggaaacacttttatcctaacatatgtaacaatttattgcactttgtgttttacatgtctatttcccttatttgaatataaatcctggggaggggaagggagaggagggatgtgggtcagtgtctggtgttgtttccctgactaacaagcatagtacttggccattagagaacacacttaactagctgctgaaagaagaaatgaataaaccatagcagtcttctgccaggctttcctgcctctagcttttcttttctgcaattcacaaccaccacagccgccaaagtcagctttcaaaaaagcacatctgcttaggtctgtctagtacttaacctttatgatctccactgacctcaggataaaattagatcatcttaacatgacatacaaaactcaaaatctggccacaacctttcctttgctttttaaatacattttatttcattcatagaagctttattcacagtagccaaaaacagaagcaacctatatattcatttacgctgaataaacaaattgctctatatccattcaatggaatatctttcagcaataaaaaaaatgtatagttggttcatgtatcttgtccagttttctgtttgtttacagtggaagggcaagtttagcatcagatactctatcatggcagaagcagatatttctagcctatttcttttgcctcatcccatcccaccgtgtggtgcagtctaccccacactacaatttttcctagactttgctgagcaatttattatgtcttaaattcttttcctgcctcagtcatctctttttcatcccacatgacctgactcatatcctacttcatctctggtagtcttccattttctctagggagagagatctttttctccctctatgtttctacagcatattgttcactacggcatttatctcaaggtactgtgtatgtctccccacgaaaatgaatttctaataataatgataatcgctaatatttgggtacttgctatgcgccaggtactgttctaagcactttacccatattaaatcattcaatcttcataaaactctatgacatagctactattatttatttatttttgagataagatctcactctgtcgcccaggctggagtgcagtggaacaatcacggctcactgcagtctcaactcccaggctcaagtgatcctctctcttcagccttccaagtagctgggaccacaggcacacaccaccacacccagctactttttaattttttttttatatagatgggatcccactgtgttgcccaggcaggtcttgaactcctgagcttcagcaatcctttcaccttagcctcccaaagtgctgggattacaggtttgagccactgcacctagccaccaggttctattactatccttgatttacagatgaagaaactaaggcacagagaagttagataaattgcctaagagctcatagcttgacagtggtagaggcaggatgtgaacccaaacagtctgattccagagctcatgattactatactgtctctcctaaattcctggacggcagcaactgggtcttattcttgtttgtacatccatgcccagagcacctcaaatatttgtggaatgaattaaaatttataattttctcctagtcatccatgaaaaagttcttcataagtaatgtaggttttcagtcagtaattacagaactgaatctagaaagggtctttcataaacatggaagagactaaaattaaatttctaataataaattcaaagagctctgaagaattttaccatgcagaaaggactaatgaggttttttaggtagccaaataacagtagtgaactcaggaacataaagtccctacaaaggaatcaacacaccctaagagaagagactaaatgtcataattcgtctccaatagctgcatactaaattaatcctatccatttaaatctgaaatcaagagcatagttttttgaaggcaaaagcaaaaggagtatttaaacaaaaatttaatcctaaaagccaaatctgtcaagagtaatcaatgaaaataaataaagccttactactcaaagaatcatctatgttttagaaacaacaaaagtctaaccaattctgtattggaaaagtattggtcactgcctgtgaaacaactaaaagtacttaaattttagtgatttatacagaaatttaagtaacgaaaatttatatataattttttataaattacatattttatatatatatatattgcacaagtggataattacatttagttagggaaacagtaataaaaccattgggtagaggttgtattgagaggaaggggacagttgatgcatgttgttaccttcagtttattccatcctaccaatctatgtcacatacctgggccatccagcttggacaagtccactatccctcatccaaagtccctgaaaccaaaccaaatgtctttcagaatccaaaatttttctgattttaggaaggtgcattttacccaacactgcagcaggaactgggcaacaccctgtaatcaaaagccttaatatttctgcatcaaatgcataaatattcatattaaatgggataaataaagactataaatagcctcacatcaatccaggtcagatgtgtaagtctaaaaaaattctgttttctgagcttttcagattttaaattgtggaaaaaggattacagacttcaactattacattgtattcaacctggtttattctctgcttgagaactgacgacggcttccttacctgccacattcagatacaatattaatttccatgctagtccggaattggcaacattattggaaataatctagtcaaactccttacttcattgcttaggaaactaaagcccagagagataaaatgacttgcctggggatcacacggttaagtactgacagagatgaaactacaacacacacatctgtctcccaggtcttctttctctttctctctctgtctctgtctgtctgtttctctctctctcgtgcatgctctctctctttctctctggatttgaagtgctttttttaaggcttttcaaaataagaaataattggccaggcgcggtggctcatgcctgtaatcccagcactttgagaggccgaggcgggcagatcacaaggtcaagagatcgagaccatctgggccaacatggtgaaaccccatctctactaaaaatacaaaagttagctgggcgtggtggtgcacacctgtagtcccagctactcgggaggctgaggcaggagaattgcttgaacccaggaggtggaggttgcagtgagtcaagattgcaccactgcactccagcctggcaacgaagcaagactccatctaaaaaaaaaagaaaaaaaagaaataattacagacaaacacaaagttgcagaaacactacagagtcccaggtacccttcacccaatggtgaaatcatgtaatagctatagaacactaaaaccaaaaaattgatattgatagattgttaactacagaccttattccattttcagcatcttttaacctgcatttattttgtgtgtaggtgtatagagttctttgcaactgtattagtctgcactcacattgctataaggaaatacccaagactgggtaattcataaagaaaagaggcttaattgactcacagttctacatggctggggaggcctcaggaaacttacaatcatggccaaaagcacctcttcacaggccagcagaagagagaatgagtgccagtaggggaaatgccagatgtttataaaaccatcagatctcatgagaactcactcactatcatgagaacagccccaatgattaaattatctcccaccagttccctcccatgacacatgggaattatggggattacagttcaagatgagatttaggtgaggacattctgaccctggcccctcccaaatctcgtgtgctcacatttcaaaatgcagtcatgatgcccttccaaaagtcccccaaagtcttaactcattccagcattaacccaaaagtccaagtccaaagtttcatgtgacacaaggcaagtcccttctacctatgagcctataaaatcaaaagcggccgggcgcagtggctcacgcctgtaatcccagcactttgggaggctgagacaggcggatcacgaggtcaggagatcgagaccatcctggctaacacggtgaaaccccatctctattaaaaatacaaaaaaaaattagccaggcatggtggtgggcgcctgtagtcccagctactcaggaggctgaggcaggagaatggcgtgaacccaggaggcagagcttgcagtgagccgagatggcaccactgcactccagcctgggcgacagagtgagaatccgtcaaaaagcaaaacaaaaaaaaatcaaaagcaagtgcattactacctagacacatctctctggggctacaggcactgggtaaatacatctgttccaaatgggagaaactggccaaaacaaaggggatacaggccccacatcaagtccggaatccaacagggcagtcattaaaccttaaaagttccaaaatgatctcctttgattccatgtctcacatccatgtcacgctattacaagaggtgggctcccacagtcttgggaaactctgcccctgtggctttgcagggaacagcccctctcctggctgctttcacagctggcattgagtgtctgaggcttttccagacacatggtgcaagctgtacgtggatctaccattctggggtctgaaggatgtttgctctcttctcacagttccactaggcagtaccccagtgggaactctgtgtgggggctccaaccctacacttcccttccgcactgccctagcagaggttctccatgagggctccacctctgcagcagacttctgcctggacatccaggaatttccatacttcctctgaaatctaggcagagatttccaaacctcaattattgtcttctacacatctcaagctcaataccacatggaagctgccaaggcttggggcttgcaccctctgaagcaacagcctgagctgtaccttggccccttttagccattgctgaagctgctgagatgcagggcaccaagtccagaagctgcatacagcagggggggctggacctggcccaggaaaccatttttctctcataggcctctaggtctatgatgggaggggctgccaagaaggtctctgacacatcctggagacattttccccattgtcttggcaattagcatttggctcctcattacttatgcaaatttgtgcagccagcttgaatttctcctcagaaaatgagtttttcttttctattacaatgtcagggttgcaaattttctaaacttttatgttctgtcacctcttgaatgctctgctgcttaaaaatttcttccactagataccctaaatcatctctctcaagttcaaagttccacagttctctagggcaagggcaaaaagctgccaatctctttgctaaagcatagcaagagtgacctttactccagttcccaacaagtttctcatttccatctaagaccacctcagcctggatttcattgtccatatcactatcagcattttgtcaaagccattcaacaagtctctaggaagttccaaactttcccacatctttcccatgtcttcttctgagccctcccaactgttccaacctctgcctgttacccagctgcaaagtcgcttccacattttcagatatctttatagcagcaccccactctctacggtaccaattagtctgttctcacattgctctaaggagatgccccagactgggtaacttataaagaaaagaggtttaattgacccagagtttcacatcttggcagaaggtgcctcttcacagggcaccaggagagagaatgagtgccagcaggggaaatgtgagatgcttataaaaccatcagctcttgtgagaagttactcactatcatgaaaacagcctggagaaaactacccccatgattcaattaccacccactgagtccctcccacgtggggattatggggattacaattcaagaggagatttgggtggggacacagccaaactgtatcagcaactttatcccatgtatagattcacacactcaccaccacaagactcccaactgttctaccacaatattcctctttgtatttacactcctccctattcctcacattgtccctgactccagaaaacacttactattctccatctccacagttttgtcattttgaaaatgatataaatgttatataaatggaatcagacaatatataaacttttgagatagactttttaaaaaattgggtaaaatttacataaaatttaccatcttaaccattttaagtgtacagctcagtagcattaagtgtattcacagtgttgtataaccaatctccagaactttttatcttgcaaaactgaaatcctataactattaaacaactctccatttcccccttcttccagtccctggagaccacctttctgtttctacacaccatttctctaaatttgactactctagacactttatataagtggaatcacacagtatttgtccttttgtgactggcttatttcacttagcataatgtcctccatatttcactcagcataatgtcctccaggttcatccatattatgacacgtgtgcaacctcaaacacgtgggctcaaacgatcctcccactttggcctctagagcagctgtctagccaacttatttttaggagccaccatgtctagttaatttatttttttatagagatggggtctcactgtgttgcccaagctggtctcaaactcctggcctcaagtgatcctcccacctcagcttcccaaagtgttgggattacaggcatgagccactgtgcctggtccctccttgttttttaaggctgaataatattccatggtaatatataccacattttgttaatcctatcaaccatcaatggacaactgggttgcttctacctcttggctactgtgaatactgctgctatgaacatgggtatacaaatatctctttgagacactgctttcaattcttttggaaacacacccagaagcagaattgttgggtcatatggtaattctatttttaattttttgatgaatgagattgacttttttcactcagaataattcatctgagattcacccaagttgttgtatcagtggttcatttctttttattgttgggtagcatttcgttgttatgtatggaccacagtttgttcaaccactcactaggatatgtgggttgtttccagttgggaaataattaaagacagaattaaaacagtataacaaacagtatatatgtagaggataaattaaagaaaggaaaactatgaatgtagggggaagaatgttgaggaatcaattcacaatgaccaactacaaaattccaacatgagagagaaaaatggtgggaaccatgatactgaagaaataacacacaaaatcatcccaaaataaaggatataggattaagttaagaaggccttcattctccactccaaaaaccatcaaggtgaaattatggaacatcattctaaagaaaggatctttcctctagaaagaacacacagccctatccaagctgtggaatgaaaatggcattaatacaagaaacttaactgcaaaggagaaatacatatatgtaggattttcaacctataattctataggttatggcagcctattacaaataagactgccacaaacatttgtgtataggttttggtatggacataagtttttatttctctggaataaatgctcaggagtctgattgctgggctacatggtaagtgtatgtttaaactgattgatcaatcaactgattgattgagacagggactgactctgtcacccacgctgaagtgcaatggcacgatcatggctcactgcagcctccaacttccgcgctcaagtgatcctcttacctcaacctcccaagtagctgggaccacaggtgtgcaccaccacacccaactaattttttatatattttgtagagacagcattttgccacattgcccaggctggtcttgaaatcctggactcaagtgatctgcctgcctcagcctcccaaagtgctgggattacaggcgtgagccactgtgcccagtcgtatgtttaattttataagaaattgttatgctgttttccagaggggccgaaccattttacattcccatcagcaatgcatgagaaatctagtttatctgcatcgttactagaattacatattatattttttattttagccattctaattggtacatagtagtatcccattgttggtagaagagctgaggcaggactggcttgtctgtcataatgtaaaagagtcttggaagatgtccgggatccagggtctgaaacccctcgtggcctttggaacaccaagctctgtgccaaagggtggaaggctacactgccgcaccacaaatctaagcccagggcataaaaccccttgtggctttgatggaatccagggctcagggcataaacccctcgtagcctctggaatgtgcacagacttgttggttccttgcttctttcttgtaaacatgccctccattatctcaagcagcagagcatattctatatgggtcaaaggaagtgctaaaccgtcacagctacacttaatgcaccactacctttctactctcacctcctcatgccctcacctgtttaccctcatgtcctcaccacctgcttctttgtttgatcaccaataaatagggcgggttcccagagctcggggcctttgcagcctccaatctagcgctggccctctggacacaccttatgaactcttaacttgtcttttctcattcctttgaccccgccagactttgtagccctcagggcctggtgttgggcccgatcacctcaacatcccattgtgattttaatttgcatttcccaaaaggctaataatgttgaacatcttttcatatgcttacttgctacctttataggtttttcttttagcccattttcttttctttcttcttcttttttgttttttaagtgacaaagtcttgctctgttgccaaggctagagtgcagtggtacaatcatagctcactgcagccttgaagtcaaactcttgggttcaaggaagcctcctgcctctgtttccctagtagctgggattacaggcatgcaccaccgcacaagctttttcccctattttctaattgtattgtttgctttcttgagtttagagagttctttttttttttgcaacagagtgtcactctgttgcccaggctggagtgcagtgccgcgatctcactgcaacctctgcctcccagattcaagtgattctcctgcctaagcctctggtgtagcttgaactacaggcacccaccaccacaccggctaatttttgtatttttagtagagacagggtttcaccatgttagccaggctggcctcaaactcctagcctcaagtgatccacctgcctcggcctcccaaagttctgggattacaggcatgagccaccgcacccaacctcttgagttcagagatttctttacataacctggatacaagcccttctttgaatatgtgatttgcaaatattttctcccagtctgtggctaaacttttcaccctctttacagggtctttcacagagctaagtttcaaacttttttttttttcttgagacagagtctcactctgtctcccaggctggcttgctgtggcgcaatctcggctcactgcaacctccgcctcccaagttcaagcgattctcctgcctcagcctcctgagtagctgggattacaggtgcacatcaccacgcccagctaatttttgtatttctagtagagatggggtttcaccatgttggtcaggctggtatcgaactcctgaccttgtgatctgcccgcctcggcctcccaaaatgctgggattacaggcgtgagccaccacgcctggccagttttgaacttttatggagtccaattattgttttcttttatgaattttttggtgtcatgtctaagaactgcttacctagccctaggtcctgaagatgttatcctatgttttcttttttttttgagactgagtcttgctctgtcgcccaagctggagtgcagtggtgcagtctcggctcactgcaacctccacctcctgggtttgagcgattctcatctcaaactcctgacctaaggtgatccacccaccttagcctcccaaagtgctgggaattcaggcatgagccactgcacccggccgtgatattatcctatgttttcttctgaaagttttatagtttaacatttcatgtttaaatccattttaagtggacattgatttcacaaataatccattttacattgatttttaaaaaatactgtgtgaggtttaggtcaaggttcatttttttgcctatgatgttcaattgttccagccctatttttagagaaagaaaaaaaaaaactatcctccctccattgaattgtttttgcacttttgttaaaaatcagttgggcatatttgtgttaatctatttctgggttctctattctgttccattgatctgtctgttcctctgccaataccgcagtgttttgattaatgcagctatatagtaagatttaacagtaggtggaatgattcctcaacccatgctttctttttccaacattttagttatcctaaaatgttctagtttttactattctagctctattcatgctgcttatccttgcttttaaggtcttccccatacctagtagaggtatggtagcctggagaagaaaggggaaaaaagaaagaatcatgaaggaaaaaaacaaatattatataactactaccctaaaacattactcatgtaatttttatccatccatccttcaatggagtcccaatttctccatgaaaggttctctactattccaagccatctctctatgtggtagctcattaaccacaagtcatttgtttccttctgttagatatttgtaaatatcttttgtgtcaactcatcaagggacagggtccatgtttcagacttcttttttttttttttttttgagacaaggtatcactccattgcccaggatggagcacagtggcacgaccacagcttactgcagcctcgacctcctgggcttaaggtatcctctcagctcagcctcccatgtagctaagactgcaggcatgcaccagcaacccggataatttttggtattttttgtagagatggggtttcaccatgttgcccaggttggtctcaaactcctgagctcaagcaatctgcctaccttggcctcccaaagttctgggattgcaggtgtgaaccaccacacctggtctagacttctttatatcacttcataagtttcaataaacatttaattaattatttatctaattatagtttacaacagagagatcctagaaaatctagatgaacaagagtaacaatgagctaaatgctcctctattcctagtaacagaatcattatctcaccaaacctcaagatttttaacctcatttctcatttagtgttaaagaatatatgtcacatctaggctgtttttcccttttcttgacaagatgtcttaggtaaagagatcagtgaatagcaaattatggtggtttcctttttttttttcctgctgtttgctaacaaagtcaccattcacgtaaactttagggctattagacatgattcacccctaacataccatgtagctttattcgaaaagtaaatggctccagcctgggcaacagagcaagactctgcctcaaaaaaataaaaataaaaaaacaaaaaaaatacagctgcttaatccttgattttagttataatttacaataatcattacctgcttaacctctggatcaaatgcctgctcctttgctgaaataactgtgtacagtgtatatacaaatatatacagatacatatccacaccccaaaagtttcttcattggctgtctatgagtttaggctgtttaaataatttgcaacacattattgtagtaaatagaataaaattatatgcagattagctctttcttttcttacaaaatacagcaacacatacatgctaggacaactttgcaaaaacttacttattctgtgcctttccagttctgtcactgtactatagtactacaaggcaggttaggcaacaattaggaaagtttcagaaccattagtctcacaaactttcatctaggatgcctctggtggcctctgaagagatcttctccaaaccctcatctgatgctattgcaactaagtagacgaactacggttctcagaatatacacattaataaggctctttttagcttcacccttttcacttctgtgctttatgatggactacaatactcataatgcaatactacagcccctatcattgacactatcatttccatcaaacacaaagaaacctccttctggattaccaaaaactaagaaatctgggccaggcgcagtggctcatgcctgtaattccaatacgttgggaggcggaggtgggcagatcatgagggcaggagctagagaccatcgtggccaacatggtgaaaccccttctctactaaaaatacaaaaattagctgggcgtggtggcacatgcctgcaatcccagttactggggaggctgaggcaggagaattgcttgaaccagggtgtcagaggttgcagtgagccgagatcaggccactgggcactccagcctggcgatagagcgagactctgtctcaaaaaaaaaaaaaaaaaaaaaaaaaaaaacttaagaaatctcttagttctagtgttatgagaactaggagtaacctgaactcagaagttgtttatgagagtataaactggtacattcactttagaaagcattctaaagataaacatgtgcacatccaacaattacgctcttgtttttatatcctcgtgacatgaacaccaaaagatatgcaaacatatttataacagcatttttcataatattaacaaatgcaacaacccaaatgttaattacaagatgactgtgaggcccggcgtggtggctcacgcctataatcccggcactttgggaggctgaggtgggcagatcacgaggtcaggagttcaagactagcctggccaatatggtgaaaccctgtccctactaaaaatacaaaaattagccaggcatggtggcgggcgcctataatcccaggtacttggggggctgaggcaggagaattacttgaacccgggaggtggaagctgcagtgagccgagactgtgccactgcactccagcctgggcaacaagagtgaaactctgtctgaaaataaataaacaaacaaaagatgactatggtatattcacacaacagaatttcacacacagtaaaaacctaatgaactacagttaaacacacaacatggatgaatctcagaaaccatgaattttaaaaaggaagtcacataaggtcatatgcaataaactatcatatttgtacattgcaaagaaaccagtaaaatgaaacattattatttagaaaaataacaatgtaattttacttatttcattttattttgagacagggtctcttgcccagacaggtgtgcagtggcacaatcacggctcacaacagccttgacctcccagctcaagcaatcgcaatcctcccaagcagctgggactacagatgtgcatccccacgcccaactaatttattttattttttgtagagatagggttttgctatgttgcccaggctggtctcgaactcctgggctcaagcaatctttctactttgcctcccaaagtgctgggatcacagacatgagacaccacaccaggacccctggtaattttgaaaaggaaaagtgtttaaaaacagtttagtgggagtcagggagatggactgaggagtacacatttagcttcaacaggactggtaaagttacaattcttaagttgggtaatagtaggcttattcgtttcattaagctttaaacatatgtgtatgtgttttgagtgtgtatcatctagaatctctggaaaactaacattccagctaatcataaggtgacattcctgataactgggaacgatgccaaggaataaaatcactttattattactatttgataacttttgtagtaagaaaatgacaggtgcctcgaaaaattaaagcaaggggtgggtaagggaagtgagtgtggctaaaaaagcaacatgaggaatccttatagtgctgaatatgttctttatcttaactgtatcaacataaataccctgcttatgatattacaccatcgtttcaaaagatgttaccattgggagaaacagggttaggtgtatattagatttgtgttatttcttccaactgcatgtaaatctaaaactacttcaaaatagaagtttacttttaaaaacaacaatagaaaaaggtccttttagtcctggatttctccaccttggcactactgacattttgcagcacctaattatttcttgtgggtctgtcctgggaattgaagggtagcatccctggcctctatccactaaatgccagtaatgtgcctccattcgtgacaaccaaaaatgtctccatacatgccaaatgtcctcagggggggaaaattgccccagttgagaaccagtgctctagtcataaaagccaagaagagatatgaaaatgttcctaattgaagaagatgaaagagatataacaactaaacgcaatacttgatcctggactgaatcctgtcctggagggtaaagaatgctataaagaacattattaggccaattaacaaaattgaaattaaatggtagattaaataaaagtattgtatcaatattaaatatacctaagttggtaactgtagcgtacttacgtaggagattactgctatgcttaggaaatacatactgaagtatttaggggaaaaggatcgtgatgtatgcaatctaccatcaaatgattcagaaaaaaatatatagaaagatatatacacgtgaatagtatatatatctgtgtgtatatgtatttaatgtatatattgacatatatagacatatctacgtagcaggtggatctgattaaagagtatgcaagtgtgttctttgaactatattatttttgtaacttcgctgtatgtttaaactaattacaattcaggtgtggggtttaagtggaagaaaaaaaaaaaacttttggccgggcacggtggctcacgcctgtaatcccagcactttgggaggccgaggcgggtggatcacgaggtcaggagattgagacgatcctggctaacacggtgaaaccccgtatctactaaaaatacaaaaacaaaattagccggacgtggtggcgggcacctgtagtcccagctactcccgcctgggcgacaaagcgagactccgtctcaaaaaaaaaaaaaaaaaaaacttttataaatcctaaaggcaggtttcacagcagtagtacagcataagtgataaacatcccaagaagataatgactactaacgggataaattcctacttcaaccccaagacattcgttggaaagaattatctaccttcagcctctctctctctccttgcctactttctggaggtgaccccctgaacagtgcgggacagaaaattaatctatcccattaaaaaaaaaaaaaatttctaggaagtgactcaataaacctacatctccgctcgatttctccacaaatcactgaggcatcttcatcctcaacaattaagaagcaaaatcgaggaaagcatacaagtgtttcaaagaaaaccacttatgcactcagctgagcaagaacgttaagtggactagagaagagacaacacggaatgtctaggaggagtgagtaaaaaggaaggactaaaaagagataaatcaggagccagtctgagagagctagaatgcgtatgcccgccagaaaaaaaagtattccaatgagtgcgagtgtgtcagcgggagaggggtagctcacctggctgtggtaagcagagggtgctgagtgcccaccagcttccgcacctgcatagcgatgttgctgagctcgtcgctcagcaggcagcgaaggctcatgaaggacgtggggtaccccacgatcttctccgcctctgacactacctgattccagtgggccggggacttggaggaccgaccacgccaagagcccaccgaggagatggtgtcgagggacggggaccaccacaggcgacgcggggaacccgaggctccaagataacgtggcaagtgcaacagcagctgccgaaagttcatggtttgagtctggaagggtctgggacctgggggtatccagaagtgccgcgggaaacaaaccaggggcagaggaggaacttacagtaactaaaaggaagcggcaattcttgaccctcagagtaaggtggcttcctggagcagtgaccagaaacgaactttaactgctgctttctgcagcccaggctgggcaaacaacagtcccagctcagcactgcccccggccacccggggtagaaaccacagccactgcctatgtggaggacgccatattggaggcatggaatgcggcc

SEQ ID NO: 243 - DNA, 14349 bp, Homo sapiens
  source 1..14349: mol_type = genomic DNA
agctgggcgcgagcgggtcggcgttgagggagccaccgccctcccgcctgcgcactgcctctcgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggaggtacccgggcgggcggcgggccgcggggcgtggggaggggcgcgggggagaagcgggcgcggggcatagcggtcctcggcgggtgggcggggccggggttgggggcggggcccgcggacttgcgcccctcccccgcccacctgcaactcccccgcccacctgcacccctacccacccaccttcaacccctgtcaattacacccactaggtgtgcttccccaccccctacaccctccgcccagtagtcactggggtgatttactcccatcgccatgtcccacttttaccgaagacaggagggagggtgggccgtgggagggggaccctggagccccgagagctgatggtgtgtctgaccaggcaccgtagctcgagcctgtaatcccaacacattgggagggaggatcgcttgagggcaggagttggaggccagcctgggcaacatagcgaggccccgtccctactacgactggaaaaacaaaggcattttgggttggatgaataaaaaaaagaaaagaaaaagatgtcttctagagaatccaacaggatgctgtagtggttgcccacacctagtctccagctacctaaggaacaaggcaaggagctgtctgcacataaggggcaggccagttcatagatgtaggcacggtcacctggcatcccatggctttcactcacaggctgctgtgctctggtgcacaggggcttccacgggtcttacttaatgtgtgtgatactatcatgtcaacacctgaaatgacactcaagagacgggagaagataccaggcatggtggctcacatctgtaatctcagcagtttgggatgctgaggtgggaggattgcttgatcccagcagttagagactagtcagggcaacagtgagaccctgcctctacaaaaatgaaaattagccaggcttggtggtgtgtgcctgtagtcccaggtgctcaggaaggtgagttgggaggattgcttgagccctggaggttgaggctgcagtgagctgtaattgtgccactgtactccagcctgggtgtgatagagtaagaccgtacctacaaacaaacaaaaacaaaaaaagcaagagaagggaaacgatgccaggtgtggtggcttacacttgtaatcccagcactttgggaggtcaaggcaggaggatggtttgaggccaggagtctgggaccagcttgggcaacacagactccatctctacaaataaaaaataaagaggagggaaggtgaagcattactggacaccgaagatggcttctaggaggcagggactaaggtagtgccagatccaggagcatgtggtatgcggagtcccaggacaatggaggccctcaacaattgaggccctcaacaggctgggctaggtgatgctcttgggaagcagatagtgttgtgctgggattgcaagccccatacacacaatgccatgggaaaatgagcaaaaatctagaagtaatctctgcaattggaaaaaagtcattagtcacagtggtgctatttttttgtgcactgtcattgggaaaatgatatggtttgagggaaagagcacaagaccacagattgcagaccagggccccaccaccagttccccccactgatgacattgccccatgtgagctccaaaactgtttccgatggcttttgtcctctctgcttcaatcctctcatctctaatatggagcaagcacttggattggtatgaagtatctttagaaaaggtttaaagagctccagaaatgttaagtattattattccaaaatgatatctgagcccttgatatacacataaaatggttttagaggacctacagaataagcgcaaggcattttcatgtcctgtgggtgcagaagagtaacagtgcatacacacacggaagtgtaactacctgtctatttctttcattcattcggtgaattttgggtctttatttgagccaggcgctgcacaaggccctgggtcagctttatttaatgtatttgtaccctattttatttcacaaaggatttgaaagctgggaaaggtactgtgtagataagcagactttcactggagcaggagagatgtaatattgaaaaggatgcatggctataatcccagcactttgggaggccaaggcaggaagatcacttgaggttaggactttgagaccagcttggccaacatggtgaaaccccatctctactaaaaatacaaaaattagttgggtgtggccatgcccacctgtagtcccagctactttggaggctggggcagcagaatctcttgaacccgggaggcagaggttgcagtgaaccgagatcgtgccattgcactccagcctgggtgttgcaatgagattccgtctcaaaaaaaaaaaaaaaagatgcatagggatacaatttgaattgatctggaggaagtttgtgggaagattaaagagaacttaaactgacctcattttttcaaatgcagtttggtagaaaccacaagcagtgcaaaacaggaaaaaaaaaaaagccttgcattttaagggaaacctcgagcttcttagggcacatttataccatcattttcatgttcctcactcagcccttacctccagaaccttagctggaccggaaaccaggctcactctacagattaggagaggagtagatgcctggaagtattcaacacacaactactgagctctgctgtgggcagcccatgattggtgaccaagatgctttccctgtctttgggaagcttggggtctagtggagtgaattgacagagggaaataattggcgatgtatcgtgctaggtgctattatagaggagaatatgacacacggtgaaggcacagtcgaagaatgtgtcattaactctgtcctaggggcaggtgagggacagtagacagaaatgctcacagatgaggggaacttgaatagaaatttctagaatgagtagatgccactaaactgtatggtgtgttggtgtgaattagaaaaagggcacatagcaggccgggcgtggtggctcacgccggtaatcccagcacttggggaggccaaggcgggcggatcatgaggtcaggagatcgagacaatcctggctaacacggtgaaaccctatctctactaaaaatacaaaaaattagccagtcgtggtggcaggcacctgtagtcccagctactcgggaggctgaggcaggagaatggtgtgaacccgagaggcggaggttgcagtgagccgagatcgcgccactgaactccagcctgggtgacacaggctgggactccgtctcaaaaaaaaaaaaaaaaagaaaaagggcacatagcagatgactctcatccaggtgcttttatgcagtgaacaacctataacactgtatgggtccatttaacttgccatatagacagaagaaggagactggtaagagcattttgggcaaagaagacaatgtgagcaagagcactaagatagtaaattcaggaagtgaaaggacactgaaggcttgagctctagagcagcgataatggagttgaggtggagagacctgatttaaaagctatcagggggccaggcacagtggctcatgcctgtaatcccagcactttgggaggccgaggcaggtggatcatgaggtcaggagatcgagaccatcctggctaacgcagtgaaaccccatctctactaaaaaaatatatatatatatacaaaaaattagccgggtgtggtggagggcgcctgtagtcccagctactccgggaggctgaggcaggagaatggcgtgaacccgggaggcggagcttgcagtgagccaacatcacgccactgcactccagcctgggagatgagtgaaactccatctcaaaaaaaaaagagctatgagggttagaatgggtaggacttggcagatgatgagggtggggcagagggaggagagagaagaaagtgttcagatggacccgtgggcttgagtgactgaatgaatggtgtggcaccaatcagaccccagggattgaagatggagcagccccagctctcattccccgttgcctgcctgagagccctggtgatttctttccagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttgggtatgtctctccctctacaatcaactttgtagtcctagcaggtgattagcgtaggcttgagtatgggaccttgatatcttccatagtacctagaagaggagatagcatattgatgaaatttaataaatgggtttattgaaagagatcaatttttttttttttttttgccaaaggagacaaagacagccagagaaattcgaaataacacactggctggatgaaattgcttcaatcatagacaattaaacaatttttattttcagctctgcgcggtgctcatgcctgtaatcccagcactttgggaggctgaggcaggtagatcacttgaggccaggagttccagaccagctcattacagcatggtgaaaccccatctctactaaaaatacaaaaattagctgggtgtggtggctcatacctgcaatcccagctactcaggaagctgaggtcgaagaatcgcttgaacccaggaggcagaggttgcagtgacccgagatcacgcctctgcgctccagcctgggcgacacgagattccatctcaaaaaacaaaacaaaatttcatttttatttatttattatttatttatttatctcattatacacccacacacacagatgtacacatacatgcacacatatatatatatgtatatatgggtgtgtgtatacatatatatatatatatatatatatgtatatatatgagctctgatgcactgaggcttccactggtcttgatgtgtgtgattctatctatctatctatctatctatctatctatctataaaaataaagataggatcttgctgtgttgcccagactggtctcaagctcctggccttaggcagtcctcccaccttggcctcctaaaatgctggtattacagtatttatttaagttttaggtgttgtttttttttcgggggctgtttttttggagatagggtcttgctatgttgcccagggtggaatgtagtggttgttcaccagtgccatcatagctcactgcatccttaaactcctggctcaagcagtcttctcccttcagcctcctgaatagctgagactacaggtgtgcgccactgcacctggctgtcctatgcaatatgagaccaggaagttgtcatctgtgtggagaggaataagtgtaatcccacatagggggatagtctaaaacaacatggagagtacctttagacctggattttggggctcagcgttgccatgggaaggaggcatggtgtgtagcagtggttaccagacttctttcagtagtttaaaggaataaaaagagatggaagactgatacagtgttgttctttaattttgccaaggaaagtctttaaaaaaaaaaaaaccctctgttgttcttgtcacttaacactaaaatgtggaaaaacacaatgtcaacaacagcaaaatagcagccaggcgtggtggtacttgcctgtagtcacagctacttgtgaggccgaggtgggaggattggttgagctcaggagttggagtctgcagtgagccatgatcctaccactgtgctccagccagggcaacagagtgagactgtcttttttttttttttttttttgagtcagcgtcttgctctgttgcccaagctgagtgcagtgatgcaagcacagctcactacagccttgacctcccaggtgcaagcaattttgctgcctcagtttcccaagtagctgggactagaggtgcacaccaccacgcctggctaatttttgatgttttttagagatgaggtttcactatgttggccaggatgttctcgaacacctggactcaagtgatcctcctgcctcagactgccaaagtgctgggattacaggcccagcctgtagtttgtgtccggcccggccgagactctgtgtcttaaaaaagaaaacaaaacctttcccaagaaaggacttctgacagtcttacatgtaaacaatttaaagactttatgtctcaggggttccatgtttgtgaaatgagaaataattatagctgctgcacaggcttgtcaaagaggattatataaagagccttggtgtgacccctagccatgtccttttcagagtacgtggctggaactcttagctccttcagtctgacattggagatgactagagaccttgaaccaagtgcccaggaggcagaaactctccaaccactacatctctgtgctggcctccaagaaggattgcccacattgtgggaaagatcatttttattctcagaaaggagcccctggtcaaataacttgcttggaagcatctgggtttccccagtgggctatcagctgcctccaatgctgagaaaacaaagtgtcacatcgctctgcagaactataaaaagatgtttgtttgcgggctgtttggggaaggaaagtgccggccccagctagcagctcccacagcacccttagctgggccttgccccagggttttgtttttcagagctcaccaaggtttgctgaagatctagaagggattttggggaggggttctgggtttgacttgaggtggatgtgcccatgctcaggtggccacagctagagagtgacagcgccaggcaagggcatggcagaaagcaggagatggcgacattcttactttggctgatgagctcctgtgacctatgattcatcagcagcagatgaagttgttgaatgactcagataaaataggcggttcagggcatttcgtagggtgcatttcttactatacagcttatgtatccctagcgtccaccgtgaaggctgcttgggcctcagtctggggtcgttccccattgtcatcagcttgctgcactctggtctaaatgtttctgctgaagctggaccatggtagatgtgggtgtagaatcagccatggctggatctgagcctctggcagcggtggctacttgagcaagcatgttcctgaacctgtctgggccccacttgagcctcatttatgacatagagataagatagcacacacccccaatgtcattgagaggattacatgggataacccatgaatagtggctggcatggagtaatacttagcgagtgttagctggtgttgtattaggtcatagactaagctgttattgaggtagcagcattatcttggggtttactcactgtcttccgcacgtacgggtgatgtatctgattactctgagcactaaataatctaaaaagctggtggcttgcacctatggtcccagttattcgggaggctgaggcaagaggactgcttgagcccaggagttagaggctgcagtgagctatgattgcaccactgccctccagcctgggtgacagaacaagatcctatctcttaaaaaagaagaaaaaaaatctgaaaagtgaattagaaggactgaatttttattttaagaaaatgcaatatgtgattttattcagccctgaaaccagtttgttcagacattagagttaggcattttacctgctctgcatagctacagaataatactagtggcaaggatggggaacacctagaactcttctgcattgctgttgggaatgtaaaatgctgcaaccactttgttaaccacgtgcttaccctatgactgaatgactctactgctaatacttaaaagaaatttgtgcttgtgtccactaaaggtttcttttgtttgtttgtttttgtgatggagtctcacactgtcacccagactggagtgcagtggcgtgatcttagctcactgcaacctccacttcccaggttgaagcagttcccctgcctcagcctccagagtagctgggattacagacacccaccaccatacctggctaatttttgtatttttagtagagatggagtttcaccgttttggccaggctggtcttaaactcctgagctcagatgatccacccacctcggcctcccaaagtgctgggatcacacgtgtgagccaccgtgcctggcctaaaggtcttatataggaatgttcatcccagctttactcataatagccaaaaactggaaacaacccaaatgtccatcaacaagacaacagggtaaataaattacaccatattcatgcaagggtatacttacataatgaataataactaataaaaacaaaaaaacaaactactggtttgtttttattatttatttggtggatacatttcaaaaacattatgttaaaggaaagaagccaggtatgaaagagaacatactatataattctgtttatatatatatttcaagaaaaggcaaaactcatctttactgatggaaggagaagttagagtggttgcttccgtagggattaactgggaagtggcatgaggaaccttaaggaatggaaatgtttcatcttgatctaggtgatggttggatgggtatattcatacttaaaaaaacaactgaactgtacagttaatatttgtacatttattgaatatttcacctcaattctaaaactatatatatataaagggctaggtgtcatatctttccattatacttacatatacctaataatacctaatattatacctaataatagtaattatagttgcttactgataacaacaactaataacacttattgaggccctactctgtgccagggattttctaatcacttaattccctaacacattatgaggttttattgttttctccaattttacagacagggaaactgagacatggagtagttaagttcatttacccagtgtaacacagctggcagtctggttttagattttgtccaatgcacactgtgtggcactgcccaggagcataagctccttgtcaccgaccctctttccttcctgcttagagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaaggtgagggtcagctgcccaggatggtgggtatgtgggaggaggtctgcaaggcatctgtgagtgtttaggtctccatcagaacaccgggggcagcattcatccagattactcaagatgcgatggagtgtcatcccttcccagtcacgctggggagattcaggttaaggtgggcctacctggcctatgacagttagcaaattgtatttcagaaggacagccctcgtcccattggcttccctttgctgtggagaaccgtgacccttgtttaagtttgtgcccttcattggccccctgagtcccttccccgggaaatctgtctttcccctcctgcatcctgccatcttcaggactgtttctctgtgcatctctgctgccctgtcctgcctcttcaccctagtgataggtgttgtgttcatccttatagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagaacagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacctctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 244 - DNA, 14349 bp, Homo sapiens; identical to SEQ ID NO: 243
  source 1..14349: mol_type = genomic DNA
